United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 34

SEQ ID NO: 46352 - protein, 2639 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 46353 - protein, 2602 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 46354 - protein, 2561 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 46355 - protein, 2150 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPGVRVMNCSAQILWGWRVQFHTGSRNQQQ

SEQ ID NO: 46356 - protein, 2578 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 46357 - protein, 2422 aa, Homo sapiens
MQEHSTRRRSLSLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 46358 - protein, 2591 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 46359 - protein, 135 aa, Homo sapiens
  MOD_RES (1)..(1): Any amino acid
XLAVEGPSKVDIQTEDLEDGTCKVSYFPTVPGVYIVSTKFADEHVPEINSSDMSAHVTSPSGRVTEAEIVPMGKNSHCVRFVPQEMGVHTVSVKYRGQHVTGSPFQFTVGPLGEGGAHKVRAGGPGLERGEAGVP

SEQ ID NO: 46360 - protein, 2633 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRADDTDSQSWRSPLKALSEFFKGDPKGDFNKTGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 46361 - protein, 2725 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 46362 - protein, 2692 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 46363 - protein, 87 aa, Homo sapiens
MQLFVRAQELHTFEVTGQETVAQIKAHVASLEGIAPEDQVVLLAGAPLEDEATLGQCGVEALTTLEVAGRMLGGGQTGEEEEEDRSG

SEQ ID NO: 46364 - protein, 75 aa, Homo sapiens
MQLFVRAQELHTFEVTGQETVAQIKAHVASLEGIAPEDQVVLLAGAPLEDEATLGQCGVEALTTLEVAGRMLGGE

SEQ ID NO: 46365 - protein, 98 aa, Homo sapiens
MQLFVRAQELHTFEVTGQETVAQIKALTTLEVAGRMLGGKVHGSLARAGKVRGQTPKVAKQEKKKKKTGRAKRRMQYNRRFVNVVPTFGKKKGPNANS

SEQ ID NO: 46366 - protein, 109 aa, Homo sapiens
MQLFVRAQELHTFEVTGQETVAQIKAHVASLEGIAPEDQVVLLAGAPLEDEATLGQCGVEALTTLEVAGRMLGGKVHGSLARAGKVRGQTPKVAKQEKKKKKTGRAKRR

SEQ ID NO: 46367 - protein, 133 aa, Homo sapiens
MQLFVRAQELHTFEVTGQETVAQIKAHVASLEGIAPEDQVVLLAGAPLEDEATLGQCGVEALTTLEVAGRMLGGKVHGSLARAGKVRGQTPKVAKQEKKKKKTGRAKRRMQYNRRFVNVVPTFGKKKGPNANS

SEQ ID NO: 46368 - protein, 75 aa, Homo sapiens; identical to SEQ ID NO: 46364

SEQ ID NO: 46369 - protein, 133 aa, Homo sapiens; identical to SEQ ID NO: 46367

SEQ ID NO: 46370 - protein, 133 aa, Homo sapiens; identical to SEQ ID NO: 46367

SEQ ID NO: 46371 - protein, 520 aa, Homo sapiens
MSAGEVERLVSELSGGTGGDEEEEWLYGDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 46372 - protein, 594 aa, Homo sapiens
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 46373 - protein, 588 aa, Homo sapiens
MSAGEVERLVSELSGGTGGDEEEEWLYGDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGIPITVPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 46374 - protein, 152 aa, Homo sapiens
MEAVLNELVSVEDLLKFEKKFQSEKAAGSVSKSTQFEYAWCLVRSKYNDDIRKGIVLLEELLPKGSKEEQRDYVFYLAVGNYRLKEYEKALKYVRGLLQTEPQNNQAKELERLIDKAMKKDGLVGMAIVGGMALGVAGLAGLIGLAVSKSKS

SEQ ID NO: 46375 - protein, 470 aa, Homo sapiens
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 46376 - protein, 582 aa, Homo sapiens
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 46377 - protein, 542 aa, Homo sapiens
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGPHAWAGP

SEQ ID NO: 46378 - protein, 81 aa, Homo sapiens
MGDFVRYHYNGTFEDGKKFDSSYDRNTLVAIVVGVGRLITGMDRGLMGMCVNERRRLIVPPHLGYGSIGLAGLIPPDATLY

SEQ ID NO: 46379 - protein, 386 aa, Homo sapiens
  MOD_RES (1)..(1): Any amino acid
XIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTDSIGFLQGSAPLRPFRSGEGQPSLGREGGYGKTEPAYPQDPAVLGASVSSPVKWASHADPQGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 46380 - protein, 355 aa, Homo sapiens
MRYHYNGSLMDGTLFDSSYSRNHTYNTYIGQGYIIPGMDQGLQGACMGERRRITIPPHLAYGENGTDSIGFLQGSAPLRPFRSGEGQPSLGREGGYGKTEPAYPQDPAVLGASVSSPVKWASHADPQGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 46381 - protein, 108 aa, Homo sapiens
MGVEIETISPGDGRTFPKKGQTCVVHYTGMLQNGKKFDSSRDRNKPFKFRIGKQEVIKGFEEGAAQMSLGQRAKLTCTPDVAYGATGHPGVIPPNATLIFDVELLNLE

SEQ ID NO: 46382 - protein, 80 aa, Homo sapiens
MGVEIETISPGDGRTFPKKGQTCVVHYTGMLQNGKKFDSSRDRNKPFKFRIGKQEVIKGFEEGAAQLGPLSPLPICPHPC

SEQ ID NO: 46383 - protein, 142 aa, Homo sapiens
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 46384 - protein, 142 aa, Homo sapiens; identical to SEQ ID NO: 46383

SEQ ID NO: 46385 - protein, 142 aa, Homo sapiens; identical to SEQ ID NO: 46383

SEQ ID NO: 46386 - protein, 102 aa, Homo sapiens
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKR

SEQ ID NO: 46387 - protein, 224 aa, Homo sapiens
MAAAVPQRAWTVEQLRSEQLPKKDIIKFLQEHGSDSFLAEHKLLGNIKNVAKTANKDHLVTAYNHLFETKRFKGTESISKVSEQVKNVKLNEDKPKETKSEETLDEGPPKYTKSVLKKGDKTNFPKKGDVVHCWYTGTLQDGTVFDTNIQTSAKKKKNAKPLSFKVGVGKVIRGWDEALLTMSKGEKARLEIEPEWAYGKKGQPDAKIPPNAKLTFEVELVDID

SEQ ID NO: 46388 - protein, 224 aa, Homo sapiens; identical to SEQ ID NO: 46387

SEQ ID NO: 46389 - protein, 457 aa, Homo sapiens
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRYGFGEAGKPKFGIEPNAELIYEVTLKSFEKAKESWEMDTKEKLEQAAIVKEKGTVYFKGGKYMQAVIQYGKIVSWLEMEYGLSEKESKASESFLLAAFLNLAMCYLKLREYTKAVECCDKALGLDSANEKGLYRRGEAQLLMNEFESAKGDFEKVLEVNPQNKAARLQISMCQKKAKEHNERDRRIYANMFKKFAEQDAKEEANKAMGKKTSEGVTNEKGTDSQAMEEEKPEGHV

SEQ ID NO: 46390 - protein, 457 aa, Homo sapiens; identical to SEQ ID NO: 46389

SEQ ID NO: 46391 - protein, 266 aa, Homo sapiens
LLMKVPRTMKKAPQPLLLSRERILPPKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRPKNPGRWIPKKNWSRLPLSKRREPYTSRCVSPYAILSISKNLFKCW

SEQ ID NO: 46392 - protein, 457 aa, Homo sapiens; identical to SEQ ID NO: 46389

SEQ ID NO: 46393 - protein, 457 aa, Homo sapiens; identical to SEQ ID NO: 46389

SEQ ID NO: 46394 - protein, 278 aa, Homo sapiens
MFDCRDVAFTVGEGEDHDIPIGIDKALEKMQREEQCILYLGPRYGFGEAGKPKFGIEPNAELIYEVTLKSFEKAKESWEMDTKEKLEQAAIVKEKGTVYFKGGKYMQAVIQYGKIVSWLEMEYGLSEKESKASESFLLAAFLNLAMCYLKLREYTKAVECCDKALGLDSANEKGLYRRGEAQLLMNEFESAKGDFEKVLEVNPQNKAARLQISMCQKKAKEHNERDRRIYANMFKKFAEQDAKEEANKAMGKKTSEGVTNEKGTDSQAMEEEKPEGHV

SEQ ID NO: 46395 - protein, 268 aa, Homo sapiens
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRPKNPGRWIPKKNWSRLPLSKRREPYTSRCVSPYAILSISKNLFKCW

SEQ ID NO: 46396 - protein, 420 aa, Homo sapiens [sequence omitted]

SEQ ID NO: 46397 - protein, 327 aa, Homo sapiens
MGGSALNQGVLEGDDAPGQSLYERLSQRMLDISGDRGVLKDVIREGAGDLVAPDASVLVKYSGYLEHMDRPFDSNYFRKTPRLMKLGEDITLWGMELGLLSMRRGELARFLFKPNYAYGTLGCPPLIPPNTTVLFEIELLDFLDCAESDKFCALSAEQQDQFPLQKVLKVAATEREFGNYLFRQNRFYDAKVRYKRALLLLRRRSAPPEEQHLVEAAKLPVLLNLSFTYLKLDRPTIALCYGEQALIIDQKNAKALFRCGQACLLLTEYQKARDFLVRAQKEQPFNHDINNELKKLASCYRDYVDKEKEMWHRMFAPCGDGSTAGES

SEQ ID NO: 46398 - protein, 322 aa, Homo sapiens
MSASSWPQNGMPPSSLYERLSQRMLDISGDRGVLKDVIREGAGDLVAPDASVLVKYSGYLEHMDRPFDSNYFRKTPRLMKLGEDITLWGMELGLLSMRRGELARFLFKPNYAYGTLGCPPLIPPNTTVLFEIELLDFLDCAESDKFCALSAEQQDQFPLQKVLKVAATEREFGNYLFRQNRFYDAKVRYKRALLLLRRRSAPPEEQHLVEAAKLPVLLNLSFTYLKLDRPTIALCYGEQALIIDQKNAKALFRCGQACLLLTEYQKARDFLVRAQKEQPFNHDINNELKKLASCYRDYVDKEKEMWHRMFAPCGDGSTAGES

SEQ ID NO: 46399 - protein, 413 aa, Homo sapiens
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGSRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 46400 - protein, 441 aa, Homo sapiens
MGVGAGRVSQSGAPSPGGAGRANSCPPSSMASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 46401 - protein, 253 aa, Homo sapiens
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 46402 - protein, 532 aa, Homo sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGVNKLPPPSVMIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 46403 - protein, 532 aa, Homo sapiens; identical to SEQ ID NO: 46402

SEQ ID NO: 46404 - protein, 469 aa, Homo sapiens
MAKRVAIVGAGVSGLASIKCCLEEGLEPTCFERSDDLGGLWRFTTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGVNKLPPPSVMIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 46405 - protein, 208 aa, Homo sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAE

SEQ ID NO: 46406 - protein, 471 aa, Homo sapiens
MAKKVAVIGAGVSGLISLKCCVDEGLEPTCFERTEDIGGVWRFKENVEDGRASIYQSVVTNTSKEMSCFSDFPMPEDFPNFLHNSKLLEYFRIFAKKFDLLKYIQFQTTVLSVRKCPDFSSSGQWKVVTQSNGKEQSAVFDAVMVCSGHHILPHIPLKSFPGMERFKGQYFHSRQYKHPDGFEGKRILVIGMGNSGSDIAVELSKNAAQVFISTRHGTWVMSRISEDGYPWDSVFHTRFRSMLRNVLPRTAVKWMIEQQMNRWFNHENYGLEPQNKYIMKEPVLNDDVPSRLLCGAIKVKSTVKELTETSAIFEDGTVEENIDVIIFATGYSFSFPFLEDSLVKVENNMVSLYKYIFPAHLDKSTLACIGLIQPLGSIFPTAELQARWVTRVFKGLCSLPSERTMMMDIIKRNEKRIDLFGESQSQTLQTNYVDYLDELALEIGAKPDFCSLLFKDPKLAVRLYFGPCNSY

SEQ ID NO: 46407 - protein, 471 aa, Homo sapiens; identical to SEQ ID NO: 46406

SEQ ID NO: 46408 - protein, 532 aa, Homo sapiens
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 46409 - protein, 532 aa, Homo sapiens; identical to SEQ ID NO: 46408

SEQ ID NO: 46410 - protein, 469 aa, Homo sapiens
MGKKVAIIGAGVSGLASIRSCLEEGLEPTCFEKSNDIGGLWKFSTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 46411 - protein, 512 aa, Homo sapiens
MPASTRSQKRQGMDSLLEPLKMNMDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 46412 - protein, 558 aa, Homo sapiens
MAKKVAVIGAGVSGLSSIKCCVDEDLEPTCFERSDDIGGLWKFTESSKDGMTRVYKSLVTNVCKEMSCYSDFPFHEDYPNFMNHEKFWDYLQEFAEHFDLLKYIQFKTTVCSITKRPDFSETGQWDVVTETEGKQNRAVFDAVMVCTGHFLNPHLPLEAFPGIHKFKGQILHSQEYKIPEGFQGKRVLVIGLGNTGGDIAVELSRTAAQVLLSTRTGTWVLGRSSDWGYPYNMMVTRRCCSFIAQVLPSRFLNWIQERKLNKRFNHEDYGLSITKGKKAKFIVNDELPNCILCGAITMKTSVIEFTETSAVFEDGTVEENIDVVIFTTGYTFSFPFFEEPLKSLCTKKIFLYKQVFPLNLERATLAIIGLIGLKGSILSGTELQARWVTRVFKGLCKIPPSQKLMMEATEKEQLIKRGVFKDTSKDKFDYIAYMDDIAACIGTKPSIPLLFLKDPRLAWEVFFGPCTPYQYRLMGPGKWDGARNAILTQWDRTLKPLKTRIVPDSSKPASMSHYLKAWGAPVLLASLLLICKSSLFLKLVRDKLQDRMSPYLVSLWRG

SEQ ID NO: 46413 - protein, 533 aa, Homo sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKRYVESQRHTIQGDYIDTMEELADLVGVRPNLLSLAFTDPKLALHLLLGPCTPIHYRVQGPGKWDGARKAILTTDDRIRKPLMTRVVERSSSMTSTMTIGKFMLALAFFAIIIAYF

SEQ ID NO: 46414 - protein, 285 aa, Homo sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRSKDIALTE

SEQ ID NO: 46415 - protein, 464 aa, Homo sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKSLTMRKTSDKPKLKNILQIPDYLKTVKIINKESLRNCPGIKGPKET

SEQ ID NO: 46416 - protein, 192 aa, Homo sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIG

SEQ ID NO: 46417 - protein, 145 aa, Homo sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVM

SEQ ID NO: 46418 - protein, 1269 aa, Homo sapiens
MEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 46419 - protein, 1183 aa, Homo sapiens
MTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 46420 - protein, 1148 aa, Homo sapiens
MEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 46421 - protein, 427 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 46422 - protein, 427 aa, Homo sapiens; identical to SEQ ID NO: 46421

SEQ ID NO: 46423 - protein, 427 aa, Homo sapiens; identical to SEQ ID NO: 46421

SEQ ID NO: 46424 - protein, 145 aa, Homo sapiens
MGVEGTGRGGCRLGGPDGKGKGWAPVDATARLPHPQRLSLPLLQLQPEPCFSLVAQMRPWWSPDYLHSLGKARTAQVQKDARIGEAEAKRDAGIREAKAKQEKVSAQYLSEIEMAKAQRDYELKKAAYDIEVNTRRAQADLAYQL

SEQ ID NO: 46425 - protein, 192 aa, Homo sapiens
MFFTCGPNEAMVVSGFCRSPPVMVAGGRVFVLPCIQQIQRISLNTLTLNVKSEKVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIE

SEQ ID NO: 46426 - protein, 192 aa, Homo sapiens; identical to SEQ ID NO: 46425

SEQ ID NO: 46427 - protein, 238 aa, Homo sapiens
MRPWWSPVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAE

SEQ ID NO: 46428 - protein, 192 aa, Homo sapiens; identical to SEQ ID NO: 46425

SEQ ID NO: 46429 - protein, 192 aa, Homo sapiens; identical to SEQ ID NO: 46425

SEQ ID NO: 46430 - protein, 145 aa, Homo sapiens; identical to SEQ ID NO: 46424

SEQ ID NO: 46431 - protein, 90 aa, Homo sapiens
  MOD_RES (1)..(1): Any amino acid
XAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 46432 - protein, 235 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQAD

SEQ ID NO: 46433 - protein, 238 aa, Homo sapiens; identical to SEQ ID NO: 46427

SEQ ID NO: 46434 - protein, 138 aa, Homo sapiens
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIE

SEQ ID NO: 46435 - protein, 185 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKR

SEQ ID NO: 46436 - protein, 115 aa, Homo sapiens
MGVEGTGRGGCRLGGPDGKGKGWAPVDATARLPHPQRLSLPLLQLQPEPCFSLVAQMRPWWSPDYLHSLGKARTAQVQKDARIGEAEAKRDAGIREAKAKQEKVSAQYLSEIEMA

SEQ ID NO: 46437 - protein, 186 aa, Homo sapiens
VAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 46438 - protein, 145 aa, Homo sapiens; identical to SEQ ID NO: 46424

SEQ ID NO: 46439 - protein, 185 aa, Homo sapiens; identical to SEQ ID NO: 46435

SEQ ID NO: 46440 - protein, 210 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMA

SEQ ID NO: 46441 - protein, 210 aa, Homo sapiens; identical to SEQ ID NO: 46440

SEQ ID NO: 46442 - protein, 252 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQ

SEQ ID NO: 46443 - protein, 147 aa, Homo sapiens
MRPWWSPVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMA

SEQ ID NO: 46444 - protein, 182 aa, Homo sapiens
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQ

SEQ ID NO: 46445 - protein, 115 aa, Homo sapiens
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKR

SEQ ID NO: 46446 - protein, 235 aa, Homo sapiens; identical to SEQ ID NO: 46432

SEQ ID NO: 46447 - protein, 427 aa, Homo sapiens; identical to SEQ ID NO: 46421

SEQ ID NO: 46448 - protein, 165 aa, Homo sapiens
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQAD

SEQ ID NO: 46449 - protein, 145 aa, Homo sapiens; identical to SEQ ID NO: 46424

SEQ ID NO: 46450 - protein, 252 aa, Homo sapiens; identical to SEQ ID NO: 46442

SEQ ID NO: 46451 - protein, 252 aa, Homo sapiens; identical to SEQ ID NO: 46442

SEQ ID NO: 46452 - protein, 82 aa, Homo sapiens
DYLHSLGKARTAQVQKDARIGEAEAKRDAGIREAKAKQEKVSAQYLSEIEMAKAQRDYELKKAAYDIEVNTRRAQADLAYQL

SEQ ID NO: 46453 - protein, 185 aa, Homo sapiens; identical to SEQ ID NO: 46435

SEQ ID NO: 46454 - protein, 252 aa, Homo sapiens; identical to SEQ ID NO: 46442

SEQ ID NO: 46455 - protein, 185 aa, Homo sapiens; identical to SEQ ID NO: 46435

SEQ ID NO: 46456 - protein, 238 aa, Homo sapiens; identical to SEQ ID NO: 46427

SEQ ID NO: 46457 - protein, 427 aa, Homo sapiens; identical to SEQ ID NO: 46421

SEQ ID NO: 46458 - protein, 192 aa, Homo sapiens; identical to SEQ ID NO: 46425

SEQ ID NO: 46459 - protein, 235 aa, Homo sapiens; identical to SEQ ID NO: 46432

SEQ ID NO: 46460 - protein, 60 aa, Homo sapiens
VAKTKQQIEEQRVQVQVVERAQQVAVQEQEIARREKELEARVRKPAEAERYKLERLAEAE

SEQ ID NO: 46461 - protein, 238 aa, Homo sapiens; identical to SEQ ID NO: 46427

SEQ ID NO: 46462 - protein, 235 aa, Homo sapiens; identical to SEQ ID NO: 46432

SEQ ID NO: 46463 - protein, 357 aa, Homo sapiens
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 46464 - protein, 11 aa, Homo sapiens
VAKTKQQIEEQ

SEQ ID NO: 46465 - protein, 252 aa, Homo sapiens; identical to SEQ ID NO: 46442

SEQ ID NO: 46466 - protein, 235 aa, Homo sapiens; identical to SEQ ID NO: 46432

SEQ ID NO: 46467 - protein, 185 aa, Homo sapiens; identical to SEQ ID NO: 46435

SEQ ID NO: 46468 - protein, 145 aa, Homo sapiens; identical to SEQ ID NO: 46424

SEQ ID NO: 46469 - protein, 238 aa, Homo sapiens; identical to SEQ ID NO: 46427

SEQ ID NO: 46470 - protein, 379 aa, Homo sapiens
MFFTCGPNEAMVVSGFCRSPPVMVAGGRVFVLPCIQQIQRISLNTLTLNVKSEKVYTRHGVPISVTGIAQEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 46471 - protein, 185 aa, Homo sapiens; identical to SEQ ID NO: 46435

SEQ ID NO: 46472 - protein, 231 aa, Homo sapiens
VKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAE

SEQ ID NO: 46473 - protein, 210 aa, Homo sapiens; identical to SEQ ID NO: 46440

SEQ ID NO: 46474 - protein, 192 aa, Homo sapiens; identical to SEQ ID NO: 46425

SEQ ID NO: 46475 - protein, 379 aa, Homo sapiens; identical to SEQ ID NO: 46470

SEQ ID NO: 46476 - protein, 379 aa, Homo sapiens; identical to SEQ ID NO: 46470

SEQ ID NO: 46477 - protein, 379 aa, Homo sapiens; identical to SEQ ID NO: 46470

SEQ ID NO: 46478 - protein, 379 aa, Homo sapiens; identical to SEQ ID NO: 46470

SEQ ID NO: 46479 - protein, 286 aa, Homo sapiens [sequence omitted]

SEQ ID NO: 46480 - protein, 483 aa, Homo sapiens
MGNCHTVGPNEALVVSGGCCGSDYKQYVFGGWAWAWWCISDTQRLSLEVMTILCRCENIETSEGVPLFVTGVAQVPCPCLLDCKWGNSKGFWKLCQVCQISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 46481 - protein, 428 aa, Homo sapiens
MGNCHTVGPNEALVVSGGCCGSDYKQYVFGGWAWAWWCISDTQRISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 46482 - protein, 993 aa, Homo sapiens
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 46483 - protein, 996 aa, Homo sapiens
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNVRLARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 46484 - protein, 952 aa, Homo sapiens
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 46485 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 46486 - protein, 735 aa, Homo sapiens
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 46487 - protein, 442 aa, Homo sapiens
MGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 46488 - protein, 719 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 46489 - protein, 545 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEDILGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKKKK

SEQ ID NO: 46490 - protein, 704 aa, Homo sapiens
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 46491 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 46492 - protein, 257 aa, Homo sapiens; identical to SEQ ID NO: 46491

SEQ ID NO: 46493 - protein, 257 aa, Homo sapiens; identical to SEQ ID NO: 46491

SEQ ID NO: 46494 - protein, 257 aa, Homo sapiens; identical to SEQ ID NO: 46491

SEQ ID NO: 46495 - protein, 255 aa, Homo sapiens
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 46496 - protein, 242 aa, Homo sapiens
MLPAATEVQLRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACATSSRTPVSMSAHPGALDPAGESELAKNASWMCPYAKRTVSAGGRIVTPPTRARATGTEDGTGPQELTSAQLGLSAAPLSPTSPLQLPFVKASGVTHTRSATTAEGAAAASRCGLIQPRATPTRKWRGSMLQPCM

SEQ ID NO: 46497 - protein, 171 aa, Homo sapiens
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRT

SEQ ID NO: 46498 - protein, 669 aa, Homo sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 46499 - protein, 633 aa, Homo sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILSELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 46500 - protein, 695 aa, Homo sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 46501 - protein, 431 aa, Homo sapiens
MEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 46502 - protein, 1138 aa, Homo sapiens
MAPTLFQKLFSKRTGLGAPGRDARDPDCGFSWPLPEFDPSQIRLIVYQDCERRGRNVLFDSSVKRRNEDISVSKLGSDAQVKVFGKCCQLKPGGDSSSSLDSSVTSSSDIKDQCLKYQGSRCSSDANMLGEMMFGSVAMSYKGSTLKIHQIRSPPQLMLSKVFTARTGSSICGSLNTLQDSLEFINQDNNTLKADNNTVINGLLGNIVHSNPMDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGDLYGAIGSPVRLARTVVVGKRQDMVQRLLYFLTYFIRCSELQETHLLENGEDEAIVMPGTVITTTLEKGEIEESEYVLVTMHRNKSSLLFKESEEIRTPNCNCKYCSHPLLGQNVENISQQEREDIQNSSKELLGISDECQMISPSDCQEENAVDVKQYRDKLRTCFDAKLETVVCTGSVPVDKCALSESGLESTEETWQSEKLLDSDSHTGKAMRSTGMVVEKKPPDKIVPASFSCEAAQTKVTFLIGDSMSPDSDTELRSQAVVDQITRHHTKPLKEERGAIDQHQETKQTTKDQSGESDTQNMVSEEPCELPCWNHSDPESMSLFDEYFNDDSIETRTIDDVPFKTSTDSKDHCCMLEFSKILCTKNNKQNNEFCKCIETVPQDSCKTCFPQQDQRDTLSILVPHGDKESSDKKIAVGTEWDIPRNESSDSALGDSESEDTGHDMTRQVSSYYGGEQEDWAEEDEIPFPGSKLIEVSAVQPNIANFGRSLLGGYCSSYVPDFVLQGIGSDERFRQCLMSDLSHAVQHPVLDEPIAEAVCIIADMDKWTVQVASSQRRVTDNKLGKEVLVSSLVSNLLHSTLQLYKHNLSPNFCVMHLEDRLQELYFKSKMLSEYLRGQMRVHVKELGVVLGIESSDLPLLAAVASTHSPYVAQILL

SEQ ID NO: 46503 - protein, 1166 aa, Homo sapiens
MAPTLFQKLFSKRTGLGAPGRDARDPDCGFSWPLPEFDPSQIRLIVYQDCERRGRNVLFDSSVKRRNEDISVSKLGSDAQVKVFGKCCQLKPGGDSSSSLDSSVTSSSDIKDQCLKYQGSRCSSDANMLGEMMFGSVAMSYKGSTLKIHQIRSPPQLMLSKVFTARTGSSICGSLNTLQDSLEFINQDNNTLKADNNTVINGLLGNIGLSQFCSPRRAFSEQGPLRLIRSASFFAVHSNPMDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGDLYGAIGSPVRLARTVVVGKRQDMVQRLLYFLTYFIRCSELQETHLLENGEDEAIVMPGTVITTTLEKGEIEESEYVLVTMHRNKSSLLFKESEEIRTPNCNCKYCSHPLLGQNVENISQQEREDIQNSSKELLGISDECQMISPSDCQEENAVDVKQYRDKLRTCFDAKLETVVCTGSVPVDKCALSESGLESTEETWQSEKLLDSDSHTGKAMRSTGMVVEKKPPDKIVPASFSCEAAQTKVTFLIGDSMSPDSDTELRSQAVVDQITRHHTKPLKEERGAIDQHQETKQTTKDQSGESDTQNMVSEEPCELPCWNHSDPESMSLFDEYFNDDSIETRTIDDVPFKTSTDSKDHCCMLEFSKILCTKNNKQNNEFCKCIETVPQDSCKTCFPQQDQRDTLSILVPHGDKESSDKKIAVGTEWDIPRNESSDSALGDSESEDTGHDMTRQVSSYYGGEQEDWAEEDEIPFPGSKLIEVSAVQPNIANFGRSLLGGYCSSYVPDFVLQGIGSDERFRQCLMSDLSHAVQHPVLDEPIAEAVCIIADMDKWTVQVASSQRRVTDNKLGKEVLVSSLVSNLLHSTLQLYKHNLSPNFCVMHLEDRLQELYFKSKMLSEYLRGQMRVHVKELGVVLGIESSDLPLLAAVASTHSPYVAQILL

SEQ ID NO: 46504 - protein, 508 aa, Homo sapiens
MAPTLFQKLFSKRTGLGAPGRDARDPDCGFSWPLPEFDPSQIRLIVYQDCERRGRNVLFDSSVKRRNEDISVSKLGSDAQVKVFGKCCQLKPGGDSSSSLDSSVTSSSDIKDQCLKYQGSRCSSDANMLGEMMFGSVAMSYKGSTLKIHQIRSPPQLMLSKVFTARTGSSICGSLNTLQDSLEFINQDNNTLKADNNTVINGLLGNIGLSQFCSPRRAFSEQGPLRLIRSASFFAVHSNPMDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGM

SEQ ID NO: 46505 - protein, 918 aa, Homo sapiens
MDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGDLYGAIGSPVRLARTVVVGKRQDMVQRLLYFLTYFIRCSELQETHLLENGEDEAIVMPGTVITTTLEKGEIEESEYVLVLLFKESEEIRTPNCNCKYCSHPLLGQNVENISQQEREDIQNSSKELLGISDECQMISPSDCQEENAVDVKQYRDKLRTCFDAKLETVVCTGSVPVDKCALSESGLESTEETWQSEKLLDSDSHTGKAMRSTGMVVEKKPPDKIVPASFSCEAAQTKVTFLIGDSMSPDSDTELRSQAVVDQITRHHTKPLKEERGAIDQHQETKQTTKDQSGESDTQNMVSEEPCELPCWNHSDPESMSLFDEYFNDDSIETRTIDDVPFKTSTDSKDHCCMLEFSKILCTKNNKQNNEFCKCIETVPQDSCKTCFPQQDQRDTLSILVPHGDKESSDKKIAVGTEWDIPRNESSDSALGDSESEDTGHDMTRQVSSYYGGEQEDWAEEDEIPFPGSKLIEVSAVQPNIANFGRSLLGGYCSSYVPDFVLQGIGSDERFRQCLMSDLSHAVQHPVLDEPIAEAVCIIADMDKWTVQVASSQRRVTDNKLGKEVLVSSLVSNLLHSTLQLYKHNLSPNFCVMHLEDRLQELYFKSKMLSEYLRGQMRVHVKELGVVLGIESSDLPLLAAVASTHSPYVAQILL

SEQ ID NO: 46506 - protein, 1114 aa, Homo sapiens
MAPTLLQKLFNKRGSSGSSAAASAQGRAPKEGPAFSWSCSEFDLNEIRLIVYQDCDRRGRQVLFDSKAVQKIEEVTAQKTEDVPIKISAKCCQGSSSVSSSSSSSISSHSSSGGSSHHAKEQLPKYQYTRPASDVNMLGEMMFGSVAMSYKGSTLKIHYIRSPPQLMISKVFSARMGSFCGSTNNLQDSFEYINQDPNLGKLNTNQNSLGPCRTGSNLAHSTPVDMPSRGQNEDRDSGIARSASLSSLLITPFPSPSSSTSSSSSYQRRWLRSQTTSLENGIIPRRSTDETFSLAEETCSSNPAMVRRKKIAISIIFSLCEKEEAQRNFQDFFFSHFPLFESHMNRLKSAIEKAMISCRKIAESSLRVQFYVSRLMEALGEFRGTIWNLYSVPRIAEPVWLTMMSGTLEKNQLCQRFLKEFTLLIEQINKNQFFAALLTAVLTYHLAWVPTVMPVDHPPIKAFSEKRTSQSVNMLAKTHPYNPLWAQLGDLYGAIGSPVRLTRTVVVGKQKDLVQRILYVLTYFLRCSELQENQLTWSGNHGEGDQVLNGSKIITALEKGEVEESEYVVITVRNEPALVPPILPPTAAERHNPWPTGFPECPEGTDSRDLGLKPDKEANRRPEQGSEACSAGCLGPASDASWKPQNAFCGDEKNKEAPQDGSSRLPSCEVLGAGMKMDQQAVCELLKVEMPTRLPDRSVAWPCPDRHLREKPSLEKVTFQIGSFASPESDFESRMKKMEERVKACGPSLEASEAADVAQDPQVSRSPFKPGFQENVCCPQNRLSEGDEGESDKGFAEDRGSRNDMAADIAGQLSHAADLGTASHGAGGTGGRRLEATRGLYVKAAEGPVLEPVAPRCVQRGPGLVAGANIPCGDDNKKANFRTEGDIPRNESSDSALGDSDDEACASAMLDLGHGGDRTGGSLEVELPLPRSQSISTQNVRNFGRSLLAGYCPTYMPDLVLHGTGSDEKLKQCLVADLVHTVHHPVLDEPIAEAVCIIADTDKWSVQVATSQRKVTDNMKLGQDVLVSSQVSSLLQSILQLYKLHLPADFCIMHLEDRLQEMYLKSKMLSEYLRGHTRVHVKELGVVLGIESNDLPLLTAIASTHSPYVAQILL

SEQ ID NO: 46507 - protein, 1137 aa, Homo sapiens
MCGGTANTTNQPESWQDSARCVSDAVPGAGRIYRALLCTKIKKHTGVDRSTDHTELDNSWSCSEFDLNEIRLIVYQDCDRRGRQVLFDSKAVQKIEEVTAQKTEDVPIKISAKCCQGSSSVSSSSSSSISSHSSSGGSSHHAKEQLPKYQYTRPASDVNMLGEMMFGSVAMSYKGSTLKIHYIRSPPQLMISKVFSARMGSFCGSTNNLQDSFEYINQDPNLGKLNTNQNSLGPCRTGSNLAHSTPVDMPSRGQNEDRDSGIARSASLSSLLITPFPSPSSSTSSSSSYQRRWLRSQTTSLENGIIPRRSTDETFSLAEETCSSNPAMVRRKKIAISIIFSLCEKEEAQRNFQDFFFSHFPLFESHMNRLKSAIEKAMISCRKIAESSLRVQFYVSRLMEALGEFRGTIWNLYSVPRIAEPVWLTMMSGTLEKNQLCQRFLKEFTLLIEQINKNQFFAALLTAVLTYHLAWVPTVMPVDHPPIKAFSEKRTSQSVNMLAKTHPYNPLWAQLGDLYGAIGSPVRLTRTVVVGKQKDLVQRILYVLTYFLRCSELQENQLTWSGNHGEGDQVLNGSKIITALEKGEVEESEYVVITVRNEPALVPPILPPTAAERHNPWPTGFPECPEGTDSRDLGLKPDKEANRRPEQGSEACSAGCLGPASDASWKPQNAFCGDEKNKEAPQDGSSRLPSCEVLGAGMKMDQQAVCELLKVEMPTRLPDRSVAWPCPDRHLREKPSLEKVTFQIGSFASPESDFESRMKKMEERVKACGPSLEASEAADVAQDPQVSRSPFKPGFQENVCCPQNRLSEGDEGESDKGFAEDRGSRNDMAADIAGQLSHAADLGTASHGAGGTGGRRLEATRGLYVKAAEGPVLEPVAPRCVQRGPGLVAGANIPCGDDNKKANFRTEGDIPRNESSDSALGDSDDEACASAMLDLGHGGDRTGGSLEVELPLPRSQSISTQNVRNFGRSLLAGYCPTYMPDLVLHGTGSDEKLKQCLVADLVHTVHHPVLDEPIAEAVCIIADTDKWSVQVATSQRKVTDNMKLGQDVLVSSQVSSLLQSILQLYKLHLPADFCIMHLEDRLQEMYLKSKMLSEYLRGHTRVHVKELGVVLGIESNDLPLLTAIASTHSPYVAQILL

SEQ ID NO: 46508 - protein, 673 aa, Homo sapiens
MCGGTANTTNQPESWQDSARCVSDAVPGAGRIYRALLCTKIKKHTGVDRSTDHTELDNSWSCSEFDLNEIRLIVYQDCDRRGRQVLFDSKAVQKIEEVTAQKTEDVPIKISAKCCQGSSSVSSSSSSSISSHSSSGGSSHHAKEQLPKYQYTRPASDVNMLGEMMFGSVAMSYKGSTLKIHYIRSPPQLMISKVFSARMGSFCGSTNNLQDSFEYINQDPNLGKLNTNQNSLGPCRTGSNLAHSTPVDMPSRGQNEDRDSGIARSASLSSLLITPFPSPSSSTSSSSSYQRRWLRSQTTSLENGIIPRRSTDETFSLAEETCSSNPAMVRRKKIAISIIFSLCEKEEAQRNFQDFFFSHFPLFESHMNRLKSAIEKAMISCRKIAESSLRVQFYVSRLMEALGEFRGTIWNLYSVPRIAEPVWLTMMSGTLEKNQLCQRFLKEFTLLIEQINKNQFFAALLTAVLTYHLAWVPTVMPVDHPPIKAFSEKRTSQSVNMLAKTHPYNPLWAQLGDLYGAIGSPVRLTRTVVVGKQKDLVQRILYVLTYFLRCSELQENQLTWSGNHGEGDQVLNGSKIITALEKGEVEESEYVVITVRNEPALVPPILPPTAAERHNPWPTGFPECPEGTDSRDLGLKPDKEANRRPEQGSEACSAGCLGPASDASWKPQNAFCG

SEQ ID NO: 46509 - protein, 219 aa, Homo sapiens
MDPAPGVLDPRAAPPALLGTPQAEVLEDVLREQFGPLPQLAAVCRLKRLPSGGYSSTENLQLVLERRRVANAKERERIKNLNRGFARLKALVPFLPQSRKPSKVDILKGATEYIQVLSDLLEGAKDSKKQDPDEQSYSNNSSESHTSSARQLSRNITQHISCAFGLKNEEEGPWADGGSGEPAHACRHSVMSTTEIISPTRSLDRFPEVELLSHRLPQV

SEQ ID NO: 46510 - protein, 344 aa, Homo sapiens
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 46511 - protein, 317 aa, Homo sapiens
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCN

SEQ ID NO: 46512 - protein, 340 aa, Homo sapiens
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCNYTEEEEEDEDQDYSFPISSILEW

SEQ ID NO: 46513 - protein, 308 aa, Homo sapiens
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 46514 - protein, 140 aa, Homo sapiens
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFS

SEQ ID NO: 46515 - protein, 251 aa, Homo sapiens
MCFVEPAGNVQSQRKGNPPVSALSNANLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 46516 - protein, 263 aa, Homo sapiens
MRPGAPGPLWPLPWGALAWAVGFVSSMGSGNPAPGGVCWLQQGQEATCSLVLQTDVTRAECCASGNIDTAWSNLTHPGNKINLLGFLGLVHCLPCKDSCDGVECGPGKACRMLGGRPRCECAPDCSGLPARLQVCGSDGATYRDECELRAARCRGHPDLSVMYRGRCRKSCEHVVCPRPQSCVVDQTGSAHCVVCRAAPCPVPSSPGQELCGNNNVTYISSCHMRQATCFLGRSIGVRHAGSCAGTPEEPPGGESAEEEENFV

SEQ ID NO: 46517 - protein, 537 aa, Homo sapiens
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 46518 - protein, 375 aa, Homo sapiens
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISVLGSQRHPGQGSCGSCPWHLCSSPHPTCGSGFGTRSGRAGRRCCGAGPSPGTWTVRTPPAARRPACAGSARRCRAARGRAVAPRFESCSSMLPGTGTRRPC

SEQ ID NO: 46519 - protein, 375 aa, Homo sapiens; identical to SEQ ID NO: 46518

SEQ ID NO: 46520 - protein, 587 aa, Homo sapiens
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 46521 - protein, 561 aa, Homo sapiens
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 46522 - protein, 194 aa, Homo sapiens
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKVDLAVVEVGIGGAYDCTNIIRKPVVCGVSSLGIDHTSLLGDTVEKIAWQKGGIFKQGVPAFTVLQPEGPLAVLRDRA

SEQ ID NO: 46523 - protein, 265 aa, Homo sapiens
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISVLGSQRHPGQGSCGSCPWHLCSSPHPTCGSGFGTRSGRAGR

SEQ ID NO: 46524 - protein, 463 aa, Homo sapiens
MHSASSMLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 46525 - protein, 457 aa, Homo sapiens
MLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 46526 - protein, 457 aa, Homo sapiens; identical to SEQ ID NO: 46525

SEQ ID NO: 46527 - protein, 343 aa, Homo sapiens
MLGAVKMEGHEPSDWSSYYAEPEGYSSVSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 46528 - protein, 350 aa, Homo sapiens
MLGSVKMEAHDLAEWSYYPEAGEVYSPVTPVPTMAPLNSYMTLNPLSSPYPPGGLPASPLPSGPLAPPAPAAPLGPTFPGLGVSGGSSSSGYGAPGPGLVHGKEMPKGYRRPLAHAKPPYSYISLITMAIQQAPGKMLTLSEIYQWIMDLFPYYRENQQRWQNSIRHSLSFNDCFVKVARSPDKPGKGSYWALHPSSGNMFENGCYLRRQKRFKLEEKVKKGGSGAATTTRNGTGSAASTTTPAATVTSPPQPPPPAPEPEAQGGEDVGALDCGSPASSTPYFTGLELPGELKLDAPYNFNHPFSINNLMSEQTPAPPKLDVGFGGYGAEGGEPGVYYQGLYSRSLLNAS

SEQ ID NO: 46529 - protein, 553 aa, Homo sapiens
MQARYSVSSPNSLGVVPYLGGEQSYYRAAAAAAGGGYTAMPAPMSVYSHPAHAEQYPGGMARAYGPYTPQPQPKDMVKPPYSYIALITMAIQNAPDKKITLNGIYQFIMDRFPFYRDNKQGWQNSIRHNLSLNECFVKVPRDDKKPGKGSYWTLDPDSYNMFENGSFLRRRRRFKKKDAVKDKEEKDRLHLKEPPPPGRQPPPAPPEQADGNAPGPQPPPVRIQDIKTENGTCPSPPQPLSPAAALGSGSAAAVPKIESPDSSSSSLSSGSSPPGSLPSARPLSLDGADSAPPPPAPSAPPPHHSQGFSVDNIMTSLRGSPQSAAAELSSGLLASAAASSRAGIAPPLALGAYSPGQSSLYSSPCSQTSSAGSSGGGGGGAGAAGGAGGAGTYHCNLQAMSLYAAGERGGHLQGAPGGAGGSAVDDPLPDYSLPPVTSSSSSSLSHGGGGGGGGGGQEAGHHPAAHQGRLTSWYLNQAGGDLGHLASAAAAAAAAGYPGQQQNFHSVREMFESQRIGLNNSPVNGNSSCQMAFPSSQSLYRTSGAFVYDCSKF

SEQ ID NO: 46530 - protein, 212 aa, Homo sapiens
MQARYSVSSPNSLGVVPYLGGEQSYYRAAAAAAGGGYTAMPAPMSVYSHPAHAEQYPGGMARAYGPYTPQPQPKDMVKPPYSYIALITMAIQNAPDKKITLNGIYQFIMDRFPFYRDNKQGWQNSIRHNLSLNECFVKVPRDDKKPGKGSYWTLDPDSYNMFENGSFLRRRRRFKKKDAVKDKEEKDRPQATRASSRTSTRCGRCSSHRGSA

SEQ ID NO: 46531 - protein, 495 aa, Homo sapiens
MTLGSCCCEIMSSESSPAALSEADADIDVVGGGSGGGELPARSGPRAPRDVLPHGHEPPAEEAEADLAEDEEESGGCSDGEPRALASRGAAAAAGSPGPGAAAARGAAGPGPGPPSGGAATRSPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLPPPHPHPHPHPELLLRGGAAAAGDPGAFLPGFAAYGAYGYGYGLALPAYGAPPPGPAPHPHPHPHAFAFAAAAAAAPCQLSVPPGRAAAPPPGPPTASVFAGAGSAPAPAPASGSGPGPGPAGLPAFLGAELGCAKAFYAASLSPPAAGTAAGLPTALLRQGLKTDAGGGAGGGGAGAGQRPSFSIDHIMGHGGGGAAPPGAGEGSPGPPFAAAAGPGGQAQVLAMLTAPALAPVAGHIRLSHPGDALLSSGSRFASKVAGLSGCHF

SEQ ID NO: 46532 - protein, 478 aa, Homo sapiens
MTLSGGGSASDMSGQTVLTAEDVDIDVVGEGDDGLEEKDSDAGCDSPAGPPELRLDEADEVPPAAPHHGQPQPPHQQPLTLPKEAAGAGAGPGGDVGAPEADGCKGGVGGEEGGASGGGPGAGSGSAGGLAPSKPKNSLVKPPYSYIALITMAILQSPQKKLTLSGICEFISNRFPYYREKFPAWQNSIRHNLSLNDCFVKIPREPGNPGKGNYWTLDPQSEDMFDNGSFLRRRKRFKRHQQEHLREQTALMMQSFGAYSLAAAAGAAGPYGRPYGLHPAAAAGAYSHPAAAAAAAAAAALQYPYALPPVAPVLPPAVPLLPSGELGRKAAAFGSQLGPGLQLQLNSLGAAAAAAGTAGAAGTTASLIKSEPSARPSFSIENIIGGGPAAPGGSAVGAGVAGGTGGSGGGSTAQSFLRPPGTVQSAALMATHQPLSLSRTTATIAPILSVPLSGQFLQPAASAAAAAAAAAQAKWPAQ

SEQ ID NO: 46533 - protein, 439 aa, Homo sapiens
MNLPRAERLRSTPQRSLRDSDGEDGKIDVLGEEEDEDEEEAASQQFLEQSLQPGLQVARWGGVALPREHIEGGGGPSDPSEFGTEFRAPPRSAAASEDARQPAKPPSSYIALITMAILQSPHKRLTLSGICAFISDRFPYYRRKFPAWQNSIRHNLSLNDCFVKIPREPGRPGKGNYWSLDPASQDMFDNGSFLRRRKRFQRHQPTPGAHLPHPFPLPAAHAALHNPRPGPLLGAPAPPQPVPGAYPNTGPGRRPYALLHPHPPRYLLLSAPAYAGAPKKAEGADLATPAPFPCCSPHLVLSLGRRARVWRRHREADASLSALRVSCKGSGERVQGLRRVCPRPRGATAPCSSDRQACRTILQQQQRHQEEDCANGCAPTKGAVLGGHLSAASALLRYQAVAEGSGLTSLAAPLGGEGTSPVFLVSPTPSSLAESAGPS

SEQ ID NO: 46534 - protein, 408 aa, Homo sapiens
MNLPRAERPRSTPQRSLRDSDGEDGKIDVLGEEEDEDEVEDEEEEASQKFLEQSLQPGLQVARWGGVALPREHIEGGGPSDPSEFGTEFRAPPRSAAASEDARQPAKPPYSYIALITMAILQSPHKRLTLSGICAFISGRFPYYRRKFPAWQNSIRHNLSLNDCFVKIPREPGHPGKGTYWSLDPASQDMFDNGSFLRRRKRFKRHQLTPGAHLPHPFPLPAAHAALHNPRPGPLLGAPALPQPVPGAYPNTAPGRRPYALLHPHPPRYLLLSAPAYAGAPKKAEGADLATPGTLPVLQPSLGPQPWEEGKGLASPPGGGCISFSIESIMQGVRGAGTGAAQSLSPTAWSYCPLLQRPSSLSDNFAATAAASGGGLRQRLRSHQGRGAGRAPVGRVGAAAVSGGGRGL

SEQ ID NO: 46535 - protein, 416 aa, Homo sapiens
MNLPRAERPRSTPQRSLRDSDGEDGKIDVLGEEEDEDEVEDEEEEARQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPHPGPLLGAPAPPQPVPGAYPNTAPGRRPYALLHPHPLRYLLLSARVYAGAPKKAEGADLATPAPFPCCSPHLVLSLGRRARVWRRHREADASLSALRVLCKGSGERVQGLRRVCPRPRGATATCSSDHQACCIPKPLPLCCKCPPPLLLGQFCSNSSSIRRTAPTAALPPRARCWAGTCRPRRRC

SEQ ID NO: 46536 - protein, 417 aa, Homo sapiens
MNLPRAERLRSTPQRSLRDSDGEDGKIDVLGEEEDEDEVEDEEEAASQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPRPGPLLGAPAPPQPVPGAYPNTAPGRRPYALLHPHPLRYLLLSAPVYAGAPKKAEGAALATPAPFPCCSPHLVLSLGRRARVWRRHREADASLSALRVLCKGSGERVQGLRRICPRPRGATATCSSDHQACCIPRPLPLCCKCPPPPLLGQFCSNSSSIRRRTAPTAALPPRARCWAGTCRPRRPC

SEQ ID NO: 46537 - protein, 373 aa, Homo sapiens
MTAESGPPPPQPEVLATVKEERGETAAGAGVPGEATGRGAGGRRRKRPLQRGKPPYSYIALIAMAIAHAPERRLTLGGIYKFITERFPFYRDNPKKWQNSIRHNLTLNDCFLKIPREAGRPGKGNYWALDPNAEDMFESGSFLRRRKRFKRSDLSTYPAYMHDAAAAAAAAAAAAAAAAIFPGAVPAARPPYPGAVYAGYAPPSLAAPPPVYYPAASPGPCRVFGLVPERPLSPELGPAPSGPGGSCAFASAGAPATTTGYQPAGCTGARPANPSAYAAAYAGPDGAYPQGAGSAIFAAAGRLAGPASPPAGGSSGGVETTVDFYGRTSPGQFGALGACYNPGGQLGGASAGAYHARHAAAYPGGIDRFVSAM

SEQ ID NO: 46538 - protein, 319 aa, Homo sapiens
MAGRSDMDPPAAFSGFPALPAVAPSGPPPSPLAGAEPGREPEEAAAGRGEAAPTPAPGPGRRRRRPLQRGKPPYSYIALIAMALAHAPGRRLTLAAIYRFITERFAFYRDSPRKWQNSIRHNLTLNDCFVKVPREPGNPGKGNYWTLDPAAADMFDNGSFLRRRKRFKRAELPAHAAAAPGPPLPFPYAPYAPAPGPALLVPPPSAGPGPSPPARLFSVDSLVNLQPELAGLGAPEPPCCAAPDAAAAAFPPCAAAASPPLYSQVPDRLVLPATRPGPGPLPAEPLLALAGPAAALGPLSPGEAYLRQPGFASGLERYL

SEQ ID NO: 46539 - protein, 444 aa, Homo sapiens
MTTEGGPPPAPLRRACSPVPGALQAALMSPPPAAAAAAAAAPETTSSSSSSSSASCASSSSSSNSASAPSAACKSAGGGGAGAGSGGAKKASSGLRRPEKPPYSYIALIVMAIQSSPSKRLTLSEIYQFLQARFPFFRGAYQGWKNSVRHNLSLNECFIKLPKGLGRPGKGHYWTIDPASEFMFEEGSFRRRPRGFRRKCQALKPMYHRVVSGLGFGASLLPQGFDFQAPPSAPLGCHSQGGYGGLDMMPAGYDAGAGAPSHAHPHHHHHHHVPHMSPNPGSTYMASCPVPAGPGGVGAAGGGGGGDYGPDSSSSPVPSSPAMASAIECHSPYTSPAAHWSSPGASPYLKQPPALTPSSNPAASAGLHSSMSSYSLEQSYLHQNAREDLSVGLPRYQHHSTPVCDRKDFVLNFNGISSFHPSASGSYYHHHHQSVCQDIKPCVM

SEQ ID NO: 46540 - protein, 489 aa, Homo sapiens [sequence omitted]

SEQ ID NO: 46541 - protein, 489 aa, Homo sapiens [sequence omitted]

SEQ ID NO: 46542 - protein, 378 aa, Homo sapiens
MSSFDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPGKGNYWTLDPNCEKMFDNGNFRRKRKRKSDVSSSTASLALEKTESSLPVDSPKTTEPQDILDGASPGGTTSSPEKRPSPPPSGAPCLNSFLSSMTAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 46543 - protein, 283 aa, Homo sapiens
MSSFDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 46544 - protein, 421 aa, Homo sapiens
MAESWLRLSGAGPAEEAGPEGGLEEPDALDDSLTSLQWLQEFSILNAKAPALPPGGTDPHGYHQVPGSAAPGSPLAADPACLGQPHTPGKPTSSCTSRSAPPGLQAPPPDDVDYATNPHVKPPYSYATLICMAMQASKATKITLSAIYKWITDNFCYFRHADPTWQNSIRHNLSLNKCFIKVPREKDEPGKGGFWRIDPQYAERLLSGAFKKRRLPPVHIHPAFARQAAQEPSAVPRAGPLTVNTEAQQLLREFEEATGEAGWGAGEGRLGHKRKQPLPKRVAKVPRPPSTLLPTPEEQGELEPLKGNFDWEAIFDAGTLGGELGALEALELSPPLSPASHVDVDLTIHGRHIDCPATWGPSVEQAADSLDFDETFLATSFLQHPWDESGSGCLPPEPLFEAGDATLASDLQDWASVGAFL

SEQ ID NO: 46545 - protein, 328 aa, Homo sapiens
MAAAAAALSGAGTPPAGGGAGGGGAGGGGSPPGGWAVARLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQRGESFAHVGNTRIRIGLPAHKAPQR

SEQ ID NO: 46546 - protein, 660 aa, Homo sapiens
MAAAAAALSGAGTPPAGGGAGGGGAGGGGSPPGGWAVARLEGREFEYLMKKRSVTIGRNSSQGSVDVSMGHSSFISRRHLEIFTPPGGGGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNAAASPLHMLATHASASASLPTKRHNGDQPEQPELKRIKTEDGEGIVIALSVDTPPAAVREKGVQN

SEQ ID NO: 46547 - protein, 610 aa, Homo sapiens
MAAARRALGAGTPRARGRGRGAGGGGSRRALGRGAPGGPRVRVSDEEALGDHRPQLVAGLGGREHGPLELHLPAPPRDLHAPGRRGHGGAAPELPPAQPRPDAGGDFYLRCLGKNGVFVDGVFQRRGAPPLQLPRVCTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNGPLGLRRPPCASSDWSCLS

SEQ ID NO: 46548 - protein, 345 aa, Homo sapiens
MSHLFDPRLPALAASPMLYLYGPERPGLPLAFAPAAALAASGRAETPQKPPYSYIALIAMAIQDAPEQRVTLNGIYQFIMDRFPFYHDNRQGWQNSIRHNLSLNDCFVKVPREKGRPGKGSYWTLDPRCLDMFENGNYRRRKRKPKPGPGAPEAKRPRAETHQRSAEAQPEAGSGAGGSGPAISRLQAAPAGPSPLLDGPSPPAPLHWPGTASPNEDAGDAAQGAAAVAVGQAARTGDGPGSPLRPASRSSPKSSDKSKSFSIDSILAGKQGQKPPSGDELLGGAKPGPGGRLGASLLAASSSLRPPFNASLMLDPHVQGGFYQLGIPFLSYFPLQVPDTVLHFQ

SEQ ID NO: 46549 - protein, 376 aa, Homo sapiens
MMASYPEPEDAAGALLAPETGRTVKEPEGPPPSPGKGGGGGGGTAPEKPDPAQKPPYSYVALIAMAIRESAEKRLTLSGIYQYIIAKFPFYEKNKKGWQNSIRHNLSLNECFIKVPREGGGERKGNYWTLDPACEDMFEKGNYRRRRRMKRPFRPPPAHFQPGKGLFGAGGAAGGCGVAGAGADGYGYLAPPKYLQSGFLNNSWPLPQPPSPMPYASCQMAAAAAAAAAAAAAAGPGSPGAAAVVKGLAGPAASYGPYTRVQSMALPPGVVNSYNGLGGPPAAPPPPPHPHPHPHAHHLHAAAAPPPAPPHHGAAAPPPGQLSPASPATAAPPAPAPTSAPGLQFACARQPELAMMHCSYWDHDSKTGALHSRLDL

SEQ ID NO: 46550 - protein, 269 aa, Homo sapiens
MMASYPEPEDAAGALLAPETGRTVKEPEGPPPSPGKGGGGGGGTAPEKPDPAQKPPYSYVALIAMAIRESAEKRLTLSGIYQYIIAKFPFYEKNKKGWQNSIRHNLSLNECFIKVPREGGGERKGNYWTLDPACEDMFEKGNYRRRRRMKRPFRPPPAHFQPGKGLFGAGGAAGGCGVAGAGADGYGYLAPPKYLQSGFLNNSWPLPQPPSPMPYASCQMAAAAAAAAAAAAAAGPGSLARPLWSRGWRARPPRTGRTHACRAWRCPPA

SEQ ID NO: 46551 - protein, 801 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVFGEQVVFGYMSKFFSGDLRDFGTPITSLFNFIFLCLSVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 46552 - protein, 763 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 46553 - protein, 748 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 46554 - protein, 648 aa, Homo sapiens
MVSLPPPQSDVTLPGPTRLEGERQGDLMQAPGLPGSPAPQSKHAGFSCSSFVSDGPPERTPSLPPHSPRIASPGPEQVQGHCPAGPGPGPFRLSPSDKYPGFGFEEAAASSPGRFLKGSHAPFHPYKRPFHEDVFPEAETTLALKGHSFKTPGPLEAFEEIPVDVAEAEAFLPGFSAEAWCNGLPYPSQEHGPQVLGSEVKVKPPVLESGAGMFCYQPPLQHMYCSSQPPFHQYSPGGGSYPIPYLGSSHYQYQRMAPQASTDGHQPLFPKPIYSYSILIFMALKNSKTGSLPVSEIYNFMTEHFPYFKTAPDGWKNSVRHNLSLNKCFEKVENKSGSSSRKGCLWALNPAKIDKMQEELQKWKRKDPIAVRKSMAKPEELDSLIGDKREKLGSPLLGCPPPGLSGSGPIRPLAPPAGLSPPLHSLHPAPGPIPGKNPLQDLLMGHTPSCYGQTYLHLSPGLAPPGPPQPLFPQPDGHLELRAQPGTPQDSPLPAHTPPSHSAKLLAEPSPARTMHDTLLPDGDLGTDLDAINPSLTDFDFQGNLWEQLKDDSLALDPLVLVTSSPTSSSMPPPQPPPHCFPPGPCLTETGSGAGDLAAPGSGGSGALGDLHLTTLYSAFMELEPTPPTAPAGPSVYLSPSSKPVALA

SEQ ID NO: 46555 - protein, 490 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQDPDIDAASAMMLLNTPPEIQAGFPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 46556 - protein, 490 aa, Homo sapiens; identical to SEQ ID NO: 46555

SEQ ID NO: 46557 - protein, 54 aa, Homo sapiens
MGPVMPPSKKPESSGISVSSGLSQCYGGSGFSKALQEDDDLDFSLPDIRLEEGA

SEQ ID NO: 46558 - protein, 93 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDD

SEQ ID NO: 46559 - protein, 468 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQVPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 46560 - protein, 208 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPY

SEQ ID NO: 46561 - protein, 468 aa, Homo sapiens; identical to SEQ ID NO: 46559

SEQ ID NO: 46562 - protein, 258 aa, Homo sapiens
MIESDTSSIMSGIIRNSGQNHHPSPQEYRLLATTSDDDLPGDLQSLSWLTAVDVPRLQQMASGRVDLGGPCVPHPHPGALAGVADLHVGATPSPLLHGPAGMAPRGMPGLGPITGHRDSQMSQFPVGGQPSSGLQDPPHLYSPATQPQFPLPPGAQQLSDRHGPEEQQDRQPACERDLQLHEGALPLLQDGPRRVEELGAAQPVSEQVLREGGEQDERLLPQGLPVGSEPGPHRQDGGGDAQVEEEGPGCHPPEYGQP

SEQ ID NO: 46563 - protein, 517 aa, Homo sapiens
MIESDTSSIMSGIIRNSGQNHHPSPQEYRLLATTSDDDLPGDLQSLSWLTAVDVPRLQQMASGRVDLGGPCVPHPHPGALAGVADLHVGATPSPLLHGPAGMAPRGMPGLGPITGHRDSMSQFPVGGQPSSGLQDPPHLYSPATQPQFPLPPGAQQCPPVGLYGPPFGVRPPYPQPHVAVHSSQELHPKHYPKPIYSYSCLIAMALKNSKTGSLPVSEIYSFMKEHFPYFKTAPDGWKNSVRHNLSLNKCFEKVENKMSGSSRKGCLWALNLARIDKMEEEMHKWKRKDLAAIHRSMANPEELDKLISDRPESCRRPGKPGEPEAPVLTHATTVAVAHGCLAVSQLPPQPLMTLSLQSVPLHHQVQPQAHLAPDSPAPAQTPPLHALPDLSPSPLPHPAMGRAPVDFINISTDMNTEVDALDPSIMDFALQGNLWEEMKDEGFSLDTLGAFADSPLGCDLGASGLTPASGGSDQSFPDLQVTGLYTAYSTPDSVAASGTSSSSQYLGAQGNKPIALL

SEQ ID NO: 46564 - protein, 337 aa, Homo sapiens
MPGLPCPALPCPAPPPAPSCLIAMALKNSKTGSLPVSEIYSFMKEHFPYFKTAPDGWKNSVRHNLSLNKCFEKVENKMSGSSRKGCLWALNLARIDKMEEEMHKWKRKDLAAIHRSMANPEELDKLISDRPESCRRPGKPGEPEAPVLTHATTVAVAHGCLAVSQLPPQPLMTLSLQSVPLHHQVQPQAHLAPDSPAPAQTPPLHALPDLSPSPLPHPAMGRAPVDFINISTDMNTEVDALDPSIMDFALQGNLWEEMKDEGFSLDTLGAFADSPLGCDLGASGLTPASGGSDQSFPDLQVTGLYTAYSTPDSVAASGTSSSSQYLGAQGNKPIALL

SEQ ID NO: 46565 - protein, 559 aa, Homo sapiens
MAAKLRAHQVDVDPDFAPQSRPRSCTWPLPQPDLAGDEDGALGAGVAEGAEDCGPERRATAPAMAPAPPLGAEVGPLRKAKSSRRNAWGNLSYADLITKAIESAPDKRLTLSQIYDWMVRYVPYFKDKGDSNSSAGWKNSIRHNLSLHTRFIRVQNEGTGKSSWWMLNPEGGKTGKTPRRRAVSMDNGAKFLRIKGKASKKKQLQAPERSPDDSSPSAPAPGPVPAAAKWAASPASHASDDYEAWADFRGGGRPLLGEAAELEDDEALEALAPSSPLMYPSPASALSPALGSRCPGELPRLAELGGPLGLHGGGGAGLPEGLLDGAQDAYGPRARAQARPGAGCAGGAGAGGRSRRLPRQRGGPVRAARALAQCLSPPHQPYDAARRGGRRGPGTAGPRRRLRGPARRPPAGRSAGALRCRRRRAAGRRARPLPGRPGPRHVQREPRVRRGVHHPQRLHGQRRNGLQLRFGPASAAAGPGRGPAPQPELGAGLRAASRLRAPRPVPRGPLSSHPDSRVPAPDSSSPGGGPSPARDPSRRPAAGEGEGGAGAPHCSCPHS

SEQ ID NO: 46566 - protein, 677 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 46567 - protein, 358 aa, Homo sapiens
MMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTPPDSRHPRPLCHHNHQHAHGGTHPQAVLRQIQRAHFVSRYCAEPRIL

SEQ ID NO: 46568 - protein, 502 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKKKKERQTLGTMPIHSTQQ

SEQ ID NO: 46569 - protein, 489 aa, Homo sapiens
MMTPQVITPQQMQQILQQQVLSPQQLQVLLQQQQALMLQLQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 46570 - protein, 677 aa, Homo sapiens; identical to SEQ ID NO: 46566

SEQ ID NO: 46571 - protein, 601 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 46572 - protein, 224 aa, Homo sapiens
MMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFL

SEQ ID NO: 46573 - protein, 679 aa, Homo sapiens
MFQCVFSSSVLQPHSTSCLFKHLFYHSATPASQKQPEPIYSKKTEIQRQTVRAPFAKLFIFSALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 46574 - protein, 123 aa, Homo sapiens
MMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGM

SEQ ID NO: 46575 - protein, 677 aa, Homo sapiens; identical to SEQ ID NO: 46566

SEQ ID NO: 46576 - protein, 114 aa, Homo sapiens
MMQESGTETKSNGSAIQNGSGGSNHLLECGGLREGRSNGETPAVDIGAADLAHAQQQQQQWHLINHQPSRSPSSWLKRLISSPWELEVLQVPLWGAVAETKMSGPVCQPNPSPF

SEQ ID NO: 46577 - protein, 222 aa, Homo sapiens
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLL

SEQ ID NO: 46578 - protein, 715 aa, Homo sapiens
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 46579 - protein, 432 aa, Homo sapiens
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPVSAYCFINSK

SEQ ID NO: 46580 - protein, 456 aa, Homo sapiens
MQESATETISNSSMNQNGMSTLSSQLDAGSRDGRSSGDTSSEVSTVELLHLQQQQALQAARQLLLQQQTSGLKSPKSSDKQRPLQELLPETKLCICGHSSGDGHPHNTFAVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPVSAYCFINSK

SEQ ID NO: 46581 - protein, 623 aa, Homo sapiens
MMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 46582 - protein, 530 aa, Homo sapiens
MMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 46583 - protein, 715 aa, Homo sapiens; identical to SEQ ID NO: 46578

SEQ ID NO: 46584 - protein, 382 aa, Homo sapiens
MMTPQVITPQQMQQILQQQVLSPQQLQALLQQQQAVMLQQDFLDSGLENFRAALEKNQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPNICKVTYRCIWMFLRFSNYAEVLLYIPEKLTPVAL

SEQ ID NO: 46585 - protein, 732 aa, Homo sapiens
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQDFLDSGLENFRAALEKNQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 46586 - protein, 740 aa, Homo sapiens
MMQESATETISNSSMNQNGMSTLSSQLDAGSRDGRSSGDTSSEVSTVELLHLQQQQALQAARQLLLQQQTSGLKSPKSSDKQRPLQELLPETKLCICGHSSGDGHPHNTFAVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 46587 - protein, 396 aa, Homo sapiens
MPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 46588 - protein, 431 aa, Homo sapiens
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 46589 - protein, 404 aa, Homo sapiens
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 46590 - protein, 396 aa, Homo sapiens; identical to SEQ ID NO: 46587

SEQ ID NO: 46591 - protein, 680 aa, Homo sapiens
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 46592 - protein, 678 aa, Homo sapiens
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 46593 - protein, 680 aa, Homo sapiens; identical to SEQ ID NO: 46591

SEQ ID NO: 46594 - protein, 667 aa, Homo sapiens
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 46595 - protein, 668 aa, Homo sapiens
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 46596 - protein, 403 aa, Homo sapiens
MKLEVFVPRAAHGDKQGSDLEGAGGSDAPSPLSAAGDDSLGSDGDCAANSPAAGGGARDTQGDGEQSAGGGPGAEEAIPAAAAAAVVAEGAEAGAAGPGAGGAGSGEGARSKPYTRRPKPPYSYIALIAMAIRDSAGGRLTLAEINEYLMGKFPFFRGSYTGWRNSVRHNLSLNDCFVKVLRDPSRPWGKDNYWMLNPNSEYTFADGVFRRRRKRLSHRAPVPAPGLRPEEAPGLPAAPPPAPAAPASPRMRSPARQEERASPAGKFSSSFAIDSILRKPFRSRRLRDTAPGTTLQWGAAPCPPLPAFPALLPAAPCRALLPLCAYGAGEPARLGAREAEVPPTAPPLLLAPLPAAAPAKPLRGPAAGGAHLYCPLRLPAALQAASVRRPGPHLPYPVETLLA

SEQ ID NO: 46597 - protein, 541 aa, Homo sapiens
MSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQIHHRVSSLLQEAKTQAALVLDCLETRQE

SEQ ID NO: 46598 - protein, 495 aa, Homo sapiens
MSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLAHGGPTGGSEAGSLCAADAGGDGGLAVAGPAGTGPVWEPGLPVRPPGGGQSPGDGRVWRIFQRAHQPEGHHRRGI

SEQ ID NO: 46599 - protein, 572 aa, Homo sapiens
MSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQPPAGSQDPGCTGAGLLGDPAGVTVREASPGSVAPPSPIPRGQSCDLETPGTAGPSTLEG

SEQ ID NO: 46600 - protein, 495 aa, Homo sapiens; identical to SEQ ID NO: 46598

SEQ ID NO: 46601 - protein, 541 aa, Homo sapiens; identical to SEQ ID NO: 46597

SEQ ID NO: 46602 - protein, 572 aa, Homo sapiens; identical to SEQ ID NO: 46599

SEQ ID NO: 46603 - protein, 592 aa, Homo sapiens
MSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKSPKQQKEPLSHRFNEFMTSKPKIHCFRSLKRGHSLLKGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKGAKTYI

SEQ ID NO: 46604 - protein, 617 aa, Homo sapiens
IRWTDELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLMSLLTSPHQPPPPPPASASPSAVPNGPQSPKQQKEPLSHRFNEFMTSKPKIHCFRSLKRGPSFKQGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 46605 - protein, 617 aa, Homo sapiens
MSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLMSLLTSPHQPPPPPPASASPSAVPNGPQSPKQQKEPLSHRFNEFMTSKPKIHCFRSLKRGHSLLKGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 46606 - protein, 608 aa, Homo sapiens
MSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKPPPPPPASASPSAVPNGPQSPKQQKEPLSHRFNEFMTSKPKIHCFRSLKRGHSLTLQGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 46607 - protein, 245 aa, Homo sapiens
MKRTIGKPTYAFEARDYVLSLKLGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 46608 - protein, 617 aa, Homo sapiens
MSWGTELWDQFDNLEKHTQWGIDILEKYIKFVKERTEIELSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKLMSLLTSPHQPPPPPPASASPSAVPNGPQSPKQQKEPLSHRFNEFMTSKPKIHCFRSLKRGLSLKLGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKDS

SEQ ID NO: 46609 - protein, 573 aa, Homo sapiens
  MOD_RES (1)..(1): Any amino acid
XLSYAKQLRNLSKKYQPKKNSKEEEEYKYTSCKAFISNLNEMNDYAGQHEVISENMASQIIVDLARYVQELKQERKSNFHDGRKAQQHIETCWKQLESSKRRFERDCKEADRAQQYFEKMDADINVTKADVEKARQQAQIRHQMAEDSKADYSSILQKFNHEQHEYYHTHIPNIFQKIQEMEERRIVRMGESMKTYAEVDRQVIPIIGKCLDGIVKAAESIDQKNDSQLVIEAYKSGFEPPGDIEFEDYTQPMKRTVSDNSLSNSRGEGKPDLKFGGKSKGKLWPFIKKNKPPPPPPASASPSAVPNGPQSPKQQKEPLSHRFNEFMTSKPKIHCFRSLKRGHSLLKGATPEDFSNLPPEQRRKKLQQKVDELNKEIQKEMDQRDAITKMKDVYLKNPQMGDPASLDHKLAEVSQNIEKLRVETQKFEAWLAEVEGRLPARSEQARRQSGLYDSQNPPTVNNCAQDRESPDGSYTEEQSQESEMKVLATDFDDEFDDEEPLPAIGTCKALYTFEGQNEGTISVVEGETLYVIEEDKGDGWTRIRRNEDEEGYVPTSYVEVCLDKNAKGAKTYI

SEQ ID NO: 46610 - protein, 1164 aa, Homo sapiens
MAGGEDRGDGEPVSVVTVRVQYLEDTDPFACANFPEPRRAPTCSLDGALPLGAQIPAVHRLLGAPLKLEDCALQVSPSGYYLDTELSLEEQREMLEGFYEEISKGRKPTLILRTQLSVRVNAILEKLYSSSGPELRRSLFSLKQIFQEDKDLVPEFVHSEGLSCLIRVGAAADHNYQSYILRALGQLMLFVDGMLGVVAHSDTIQWLYTLCASLSRLVVKTALKLLLVFVEYSENNAPLFIRAVNSVASTTGAPPWANLVSILEEKNGADPELLVYTVTLINKTLAALPDQDSFYDVTDALEQQGMEALVQRHLGTAGTDVDLRTQLVLYENALKLEDGDIEEAPGAGGRRERRKPSSEEGKRSRRSLEGGGCPARAPEPGPTGPASPVGPTSSTGPALLTGPASSPVGPPSGLQASVNLFPTISVAPSADTSSERSIYKARFLENVAAAETEKQVALAQGRAETLAGAMPNEAGGHPDARQLWDSPETAPAARTPQSPAPCVLLRAQRSLAPEPKEPLIPASPKAEPIWELPTRAPRLSIGDLDFSDLGEDEDQDMLNVESVEAGKDIPAPSPPLPLLSGVPPPPPLPPPPPIKGPFPPPPPLPLAAPLPHSVPDSSALPTKRKTVKLFWRELKLAGGHGVSASRFGPCATLWASLDPVSVDTARLEHLFESRAKEVLPSKKAGEGRRTMTTVLDPKRSNAINIGLTTLPPVHVIKAALLNFDEFAVSKDGIEKLLTMMPTEEERQKIEEAQLANPDIPLGPAENFLMTLASIGGLAARLQLWAFKLDYDSMEREIAEPLFDLKVGMEQLVQNATFRCILATLLAVGNFLNGSQSSGFELSYLEKVSEVKDTVRRQSLLHHLCSLVLQTRPESSDLYSEIPALTRCAKVDFEQLTENLGQLERRSRAAEESLRSLAKHELAPALRARLTHFLDQCARRVAMLRIVHRRVCNRFHAFLLYLGYTPQAAREVRIMQFCHTLREFALEYRTCRERVLQQQQKQATYRERNKTRGRMITETEKFSGVAGEAPSNPSVPVAVSSGPGRGDADSHASMKSLLTSRPEDTTHNRRSRGMVQSSSPIMPTVGPSTASPEEPPGSSLPSDTSDEIMDLLVQSVTKSSPRALAARERKRSRGNRKSLRRTLKSGLGDDLVQALGLSKGPGLEV

SEQ ID NO: 46611 - protein, 1439 aa, Homo sapiens
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKYSNFGNNSYHSSRPSSGSSVPTTPTSSVSPPQEARLERSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 46612 - protein, 1422 aa, Homo sapiens
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKYSNFGNNSYHSSRPSSGSSVPTTPTSSVSPPQEARLERSSPSGLLTSSFRQHQESLAAERERRRQEREERLQRIEREERNKFRYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 46613 - protein, 1401 aa, Homo sapiens
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 46614 - protein, 350 aa, Homo sapiens
METNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPLRVLSFVAAAFFLCWSPYQVVALIATVRIRELLQGMYKEIGIAVDVTSALAFFNSCLNPMLYVFMGQDFRERLIHALPASLERALTEDSTQTSDTATNSTLPSAEVELQAK

SEQ ID NO: 46615 - protein, 350 aa, Homo sapiens; identical to SEQ ID NO: 46614

SEQ ID NO: 46616 - protein, 351 aa, Homo sapiens
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNHRTVSLAMKVIVGPWILALVLTLPVFLFLTTVTIPNGDTYCTFNFASWGGTPEERLKVAITMLTARGIIRFVIGFSLPMSIVAICYGLIAAKIHKKGMIKSSRPLRVLTAVVASFFICWFPFQLVALLGTVWLKEMLFYGKYKIIDILVNPTSSLAFFNSCLNPMLYVFVGQDFRERLIHSLPTSLERALSEDSAPTNDTAANSASPPAETELQAM

SEQ ID NO: 46617 - protein, 351 aa, Homo sapiens; identical to SEQ ID NO: 46616

SEQ ID NO: 46618 - protein, 353 aa, Homo sapiens
METNFSIPLNETEEVLPEPAGHTVLWIFSLLVHGVTFVFGVLGNGLVIWVAGFRMTRTVNTICYLNLALADFSFSAILPFRMVSVAMREKWPFGSFLCKLVHVMIDINLFVSVYLITIIALDRCICVLHPAWAQNHRTMSLAKRVMTGLWIFTIVLTLPNFIFWTTISTTNGDTYCIFNFAFWGDTAVERLNVFITMAKVFLILHFIIGFSVPMSIITVCYGIIAAKIHRNHMIKSSRPLRVFAAVVASFFICWFPYELIGILMAVWLKEMLLNGKYKIILVLINPTSSLAFFNSCLNPILYVFMGRNFQERLIRSLPTSLERALTEVPDSAQTSNTDTTSASPPEETELQAM

SEQ ID NO: 46619 - protein, 271 aa, Homo sapiens
MFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQISPEEEERRRVRRERNKLAAAKCRNRRKELTDFLQAETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 46620 - protein, 169 aa, Homo sapiens
MFRDFGEPGPSSGNGGGYGGPAQPPAAAQAAQQETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 46621 - protein, 116 aa, Homo sapiens
MFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQISPEEEESWQPRDFVDP

SEQ ID NO: 46622 - protein, 326 aa, Homo sapiens
MYQDYPGNFDTSSRGSSGSPAHAESYSSGGGGQQKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 46623 - protein, 287 aa, Homo sapiens
MPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 46624 - protein, 323 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGKRTVSRVSHPVSKARKPPVCHGKRLPLTLFPSANLRGRHPGGERTCPSWVVVLYRKNRSLAAPRGPGLVKAPVWWPMKDNPGTTTASTAKNAP

SEQ ID NO: 46625 - protein, 257 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSV

SEQ ID NO: 46626 - protein, 210 aa, Homo sapiens
MASHRHSGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKGLVKAPVWWPMKDNPGTTTASTAKNAP

SEQ ID NO: 46627 - protein, 296 aa, Homo sapiens
MASHRHSGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 46628 - protein, 280 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 46629 - protein, 280 aa, Homo sapiens; identical to SEQ ID NO: 46628

SEQ ID NO: 46630 - protein, 323 aa, Homo sapiens; identical to SEQ ID NO: 46624

SEQ ID NO: 46631 - protein, 204 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVE

SEQ ID NO: 46632 - protein, 207 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQY

SEQ ID NO: 46633 - protein, 141 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSF

SEQ ID NO: 46634 - protein, 207 aa, Homo sapiens; identical to SEQ ID NO: 46632

SEQ ID NO: 46635 - protein, 320 aa, Homo sapiens
MSHFILRHLGSCFQPYPAFAEYILSATHPASGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 46636 - protein, 205 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVED

SEQ ID NO: 46637 - protein, 155 aa, Homo sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHE

SEQ ID NO: 46638 - protein, 280 aa, Homo sapiens; identical to SEQ ID NO: 46628

SEQ ID NO: 46639 - protein, 260 aa, Homo sapiens [sequence omitted]

SEQ ID NO: 46640 - protein, 309 aa, Homo sapiens
MTFYVASLALELIWMLSSPAGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 46641 - protein, 275 aa, Homo sapiens
MASHRHSGPSSYKVGTMAEKFDCHYCRDPLQGKKYVQKDGHHCCLKCFDKFCANTCVECRKPIGADSKEVHYKNRFWHDTCFRCAKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 46642 - protein, 280 aa, Homo sapiens; identical to SEQ ID NO: 46628

SEQ ID NO: 46643 - protein, 279 aa, Homo sapiens
MTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 46644 - protein, 151 aa, Homo sapiens
MTERFDCHHCNESLFGKKYILREESPYCVVCFETLFANTCEECGKPIGCDCKVPARWSTRAAAGMRPASSATAASSQLEPRVSSPKTIRISVCPAMRNNMPCSAFSAKSPSPREGSLTGSSPGTRSASCAPPAGSSCLGSASQLAMTLPTA

SEQ ID NO: 46645 - protein, 389 aa, Homo sapiens
MTRRGFSRAGAAQRSTRPAAEPQPPAARALQPRPGVPGPLRCREYLQPPAPRREAEGLSHQGSEVGAESGARPKERGAEPELGRLWLRTVSSWRLGWHFDFGVAEKPGVKMTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 46646 - protein, 279 aa, Homo sapiens; identical to SEQ ID NO: 46643

SEQ ID NO: 46647 - protein, 279 aa, Homo sapiens; identical to SEQ ID NO: 46643

SEQ ID NO: 46648 - protein, 279 aa, Homo sapiens; identical to SEQ ID NO: 46643

SEQ ID NO: 46649 - protein, 279 aa, Homo sapiens; identical to SEQ ID NO: 46643

SEQ ID NO: 46650 - protein, 279 aa, Homo sapiens; identical to SEQ ID NO: 46643

SEQ ID NO: 46651 - protein, 279 aa, Homo sapiens; identical to SEQ ID NO: 46643

SEQ ID NO: 46652 - protein, 19 aa, Homo sapiens
MTERFDCHHCNESLFGKKY

SEQ ID NO: 46653 - protein, 144 aa, Homo sapiens
MTRRGFSRAGAAQRSTRPAAEPQPPAARALQPRPGVPGPLRCREYLQPPAPRREAEGLSHQGSEVGAESGARPKERGAEPELGRLWLRTVSSWRLGWHFDFGTESRFVAQAGVQWHDLSSLQALPLGSRHSPAPASQVAGTTGC

SEQ ID NO: 46654 - protein, 280 aa, Homo sapiens
MSESFDCAKCNESLYGRKYIQTDSGPYCVPCYDNTFANTCAECQQLIGHDSRELFYEDRHFHEGCFRCCRCQRSLADEPFTCQDSELLCNDCYCSAFSSQCSACGETVMPGSRKLEYGGQTWHEHCFLCSGCEQPLGSRSFVPDKGAHYCVPCYENKFAPRCARCSKTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 46655 - protein, 284 aa, Homo sapiens
MTTAHFYCQYCTASLLGKKYVLKDDSPYCVTCYDRVFSNYCEECKKPIESDSKDLCYKDRHWHEGCFKCTKCNHSLVEKPFAAKDERLLCTECYSNECSSKCFHCKRTIMPGSRKMEFKGNYWHETCFVCENCRQPIGTKPLISKESGNYCVPCFEKEFAHYCNFCKKVITSGGITFCDQLWHKECFLCSGCRKDLCEEQFMSRDDYPFCVDCYNHLYANKCVACSKPISGLTGAKFICFQDSQWHSECFNCGKCSVSLVGKGFLTQNKEIFCQKCGSGMDTDI

SEQ ID NO: 46656 - protein, 210 aa, Homo sapiens
MTTAHFYCQYCTASLLGKKYVLKDDSPYCVTCYDRVFSNYCEECKKPIESDSKDLCYKDRHWHEGCFKCTKCNHSLVEKPFAAKDERLLCTECYSNECSSKCFHCKRTIMPGSRKMEFKGNYWHETCFVCENCRQPIGTKPLISKESGNYCVPCFEKEFAHYCNFCKKVITSGGITFCDQLWHKECFLCSGCRKDLCEEQFMSRDDYPFC

SEQ ID NO: 46657 - protein, 284 aa, Homo sapiens; identical to SEQ ID NO: 46655

SEQ ID NO: 46658 - protein, 437 aa, Homo sapiens
MGRRMRGAAATAGLWLLALGSLLALWGGLLPPRTELPASRPPEDRLPRRPARSGGPAPAPRFPLPPPLAWDARGGSLKTFRALLTLAAGADGPPRQSRSEPRWHVSARQPRPEESAAVHGGVFWSRGLEEQVPPGFSEAQAAAWLEAARGARMVALERGGCGRSSNRLARFADGTRACVRYGINPEQIQGEALSYYLARLLGLQRHVPPLALARVEARGAQWAQVQEELRAAHWTEGSVVSLTRWLPNLTDVVVPAPWRSEDGRLRPLRDAGGELANLSQAELVDLVQWTDLILFDYLTANFDRLVSNLFSLQWDPRVMQRATSNLHRGPGGALVFLDNEAGLVHGYRVAGMWDKYNEPLLQSVCVFRERTARRVLELHRGQDAAARLLRLYRRHEPRFPELAALADPHAQLLQRRLDFLAKHILHCKAKYGRRSGT

SEQ ID NO: 46659 - protein, 103 aa, Homo sapiens
MERQQQQQQQLRNLRDFLLVYNRMTELCFQRCVPSLHHRALDAEEEACLHSCAGKLIHSNHRLMAAYVQLMPALVQRRIADYEAASAVPGVAAEQPGVSPSGS

SEQ ID NO: 46660 - protein, 103 aa, Homo sapiens; identical to SEQ ID NO: 46659

SEQ ID NO: 46661 - protein, 103 aa, Homo sapiens; identical to SEQ ID NO: 46659

SEQ ID NO: 46662 - protein, 315 aa, Homo sapiens
MHGHGGYDSDFSDDERCGESSKRKKRTVEDDLLLQKPFQKEKHGKVAHKQVAAELLDREEARNRRFHLIAMDAYQRHTKFVNDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLRNSDEEESASESELWKGPLPETDEKSQEEEFDEYFQDLFL

SEQ ID NO: 46663 - protein, 315 aa, Homo sapiens
MHGHGGYDSDFSDDERCGESSKRKKRTVEDDLLLQKPFQKEKHGKVAHKQVAAELLDREEARNRRFHLIAMDAYQRHTKFVNDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLRRMLEELQMFTWEKSERMGGKRLIIIIGEELSANVTTFKM

SEQ ID NO: 46664 - protein, 313 aa, Homo sapiens
MHGHGGYDSDFSDDERCGESSKRKKRTVEDDLLLQKPFQKEKHGKVAHKQVAAELLDREEARNRRFHLIAMDAYQRHTKFVNDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLNGVMLFHPGWSAVARSQLTAAPASQVQTNNHYWRGVVC

SEQ ID NO: 46665 - protein, 292 aa, Homo sapiens
MHGHGGYDSDFSDDERCGESSKRKKRTVEDDLLLQKPFQKEKHGKVAHKQVAAELLDREEARNRRFHLIAMDAYQRHTKFVNDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLKTYFVGLLSESNEKTYM

SEQ ID NO: 46666 - protein, 276 aa, Homo sapiens
MHGHGGYDSDFSDDERCGESSKRKKRTVEDDLLLQKPFQKEKHGKVAHKQVAAELLDREEARNRRFHLIAMDAYQRHTKFVNDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLN

SEQ ID NO: 46667 - protein, 611 aa, Homo sapiens
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQIRVDCNNERSVHTKTLQNTSSEGSRLRTGKDRNQKKEKPDSVDGQQPLVNGVP

SEQ ID NO: 46668 - protein, 297 aa, Homo sapiens
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGLKI

SEQ ID NO: 46669 - protein, 590 aa, Homo sapiens
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRVLVASSVVAGESQKPELKAWQGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSAPTEEERESFLRRGDGRRRGGGGRGQGGRGRGGGFKGNDDHSRTDNRPRNPREAKGRTTDGSLQNTSSEGSRLRTGKDRNQKKEKPDSVDGQQPLVNGVP

SEQ ID NO: 46670 - protein, 537 aa, Homo sapiens
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRVLVASSVVAGESQKPELKAWQGMVPFVFVGTKDSIANATVLLDYHLNYLKLQQRKRGRASCAEETDGGVEGEEEDKEEEDVEEASKETTITPEQIIVHVIQERLKEEQQMDPFRSELTAIMKGVSTLKHYRIPPVKVVGCARVKIVTRRKRSQTAWMVSNHS

SEQ ID NO: 46671 - protein, 632 aa, Homo sapiens [sequence omitted]

SEQ ID NO: 46672 - protein, 582 aa, Homo sapiens
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSESDHRDELSDWSLAPTEEERESFLRRGDGRRRGGGGRGQGGRGRGGGFKGNDDHSRTDNRPRNPREAKGRTTDGSLQNTSSEGSRLRTGKDRNQKKEKPDSVDGQQPLVNGVP

SEQ ID NO: 46673 - protein, 592 aa, Homo sapiens
MEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQNTSSEGSRLRTGKDRNQKKEKPDSVDGQQPLVNGVP

SEQ ID NO: 46674 - protein, 262 aa, Homo sapiens
MPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQNTSSEGSRLRTGKDRNQKKEKPDSVDGQQPLVNGVP

SEQ ID NO: 46675 - protein, 536 aa, Homo sapiens
MMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 46676 - protein, 621 aa, Homo sapiens
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 46677 - protein, 539 aa, Homo sapiens
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLGKRCD

SEQ ID NO: 46678 - protein, 608 aa, Homo sapiens
MVTEGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 46679 - protein, 673 aa, Homo sapiens
MGGLASGGDVEPGLPVEVRGSNGAFYKGFVKDVHEDSVTIFFENNWQSERQIPFGDVRLPPPADYNKEITEGDEVEVYSRANEQEPCGWWLARVRMMKGDFYVIEYAACDATYNEIVTLERLRPVNPNPLATKGSFFKVTMAVPEDLREACSNENVHKEFKKALGANCIFLNITNSELFILSTTEAPVKRASLLGDMHFRSLRTKLLLMSRNEEATKHLETSKQLAAAFQEEFTVREDLMGLAIGTHGANIQQARKVPGVTAIELGEETCTFRIYGETPEACRQARSYLEFSEDSVQVPRNLVGKVIGKNGKVIQEIVDKSGVVRVRVEGDNDKKNPREEGMVPFIFVGTRENISNAQALLEYHLSYLQEVEQLRLERLQIDEQLRQIGLGFRPPGSGRGSGGSDKAGYSTDESSSSSLHATRTYGGSYGGRGRGRRTGGPAYGPSSDVSTASETESEKREEPNRAGPGDRDPPTRGEESRRRPTGGRGRGPPPAPRPTSRYNSSSISSVLKDPDSNPYSLLDTSEPEPPVDSEPGEPPPASARRRRSRRRRTDEDRTVMDGGLESDGPNMTENGLEDESRPQRRNRSRRRRNRGNRTDGSISGDRQPVTVADYISRAESQSRQRPPLERTKPSEDSLSGQKGDSVSKLPKGPSENGELSAPLELGSMVNGVS

SEQ ID NO: 46680 - protein, 2179 aa, Homo sapiens
MNSLSWGAANAVLLLLLLAWASPTFISINRGVRVMKGHSAFLSGDDLKFAIPKEKDACKVEVVMNEPITQRVGKLTPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPESQLRAKLKCPGGSCTPGLKKIGSLKVSCEEFLLMGLRYQHLDPPSPNIDYISIQLDLTDTRSKIVYKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEVELEVYDFFFERSAPMTVHISIRTADTNAPRVSWNTGLSLLEGQSRAITWEQFQVVDNDDIGAVRLVTVGGLQHGWLTLRGGKGFLFTVADLQAGVVRYHHDDSDSTKDFVVFRIFDGHHSIRHKFPINVLPKDDSPPFLITNVVIELEEGQTILIQGSMLRASDVDASDDYIFFNITKPPQAGEIMKKPGPGLIGYPVHGFLQRDLFNGIIYYRHFGGEIFEDSFQFVLWDSHEPPNLSVPQVATIHITPVDDQLPKEAPGVSRHLVVKETEVAYITKKQLHFIDSESYDRELVYTITTPPFFSFSHRHLDAGKLFMVDSIPKVVKNPTALELRSFTQHAVNYMKVAYMPPMQDIGPHCRDVQFTFSVSNQHGGTLHGICFNITILPVDNQVPEAFTNPLKVTEGGQSIISTEHILISDADTKLDNIDLSLRELPLHGRVELNGFPLNSGGTFSWGDLHTLKVRYQHDGTEVLQDDLLLEVTDGTNSAEFVLHVEVFPVNDEPPVLKADLMPVMNCSEGGEVVITSEYIFATDVDSDNLKLMFVIAREPQHGVVRRAGVTVDQFSQRDVISEAVTYKHTGGEIGLMPCFDTITLVVSDGEAGPFVNGCCYNGPNPSVPLHASFPVYDLNITVYPVDNQPPSIAIGPVFVVDEGCSTALTVNHLSATDPDTAADDLEFVLVSPPQFGYLENILPSVGFEKSNIGISIDSFQWKDMNAFHINYVQSRHLRIEPTADQFTVYVTDGKHHSLEIPFSIIINPTNDEAPDFVVQNITVCEGQMKELDSSIISAVDLDIPQDALLFSITQKPRHGLLIDRGFSKDFSENKQPANPHQKHAPVHSFSMELLKTGMRLTYMHDDSESLADDFTIQLSDGKHKILKTISVEVIPVNDEKPMLSKKAEIAMNMGETRIISSAILSAIDEDSPREKIYYVFERLPQNGQLQLKIGRDWVPLSPGMKCTQEEVDLNLLRYTHTGAMDSQNQDSFTFYLWDGNNRSPALDCQITIKDMEKGDIVILTKPLVVSKGDRGFLTTTTLLAVDGTDKPEELLYVITSPPRYGQIEYVHYPGVPITNFSQMDVVGQTVCYVHKSKVTVSSDRFRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSQRSKLGKSCVLVQRQGKWQTKDCRRAKPHNYVCSRKL

SEQ ID NO: 46681 - protein, 2180 aa, Homo sapiens
MNSLSWGAANAVLLLLLLAWASPTFISINRGVRVMKGHSAFLSGDDLKFAIPKEKDACKVEVVMNEPITQRVGKLTPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPESQLRAKLKCPGGSCTPGLKKIGSLKVSCEEFLLMGLRYQHLDPPSPNIDYISIQLDLTDTRSKIVYKKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEVELEVYDFFFERSAPMTVHISIRTADTNAPRVSWNTGLSLLEGQSRAITWEQFQVVDNDDIGAVRLVTVGGLQHGWLTLRGGKGFLFTVADLQAGVVRYHHDDSDSTKDFVVFRIFDGHHSIRHKFPINVLPKDDSPPFLITNVVIELEEGQTILIQGSMLRASDVDASDDYIFFNITKPPQAGEIMKKPGPGLIGYPVHGFLQRDLFNGIIYYRHFGGEIFEDSFQFVLWDSHEPPNLSVPQVATIHITPVDDQLPKEAPGVSRHLVVKETEVAYITKKQLHFIDSESYDRELVYTITTPPFFSFSHRHLDAGKLFMVDSIPKVVKNPTALELRSFTQHAVNYMKVAYMPPMQDIGPHCRDVQFTFSVSNQHGGTLHGICFNITILPVDNQVPEAFTNPLKVTEGGQSIISTEHILISDADTKLDNIDLSLRELPLHGRVELNGFPLNSGGTFSWGDLHTLKVRYQHDGTEVLQDDLLLEVTDGTNSAEFVLHVEVFPVNDEPPVLKADLMPVMNCSEGGEVVITSEYIFATDVDSDNLKLMFVIAREPQHGVVRRAGVTVDQFSQRDVISEAVTYKHTGGEIGLMPCFDTITLVVSDGEAGPFVNGCCYNGPNPSVPLHASFPVYDLNITVYPVDNQPPSIAIGPVFVVDEGCSTALTVNHLSATDPDTAADDLEFVLVSPPQFGYLENILPSVGFEKSNIGISIDSFQWKDMNAFHINYVQSRHLRIEPTADQFTVYVTDGKHHSLEIPFSIIINPTNDEAPDFVVQNITVCEGQMKELDSSIISAVDLDIPQDALLFSITQKPRHGLLIDRGFSKDFSENKQPANPHQKHAPVHSFSMELLKTGMRLTYMHDDSESLADDFTIQLSDGKHKILKTISVEVIPVNDEKPMLSKKAEIAMNMGETRIISSAILSAIDEDSPREKIYYVFERLPQNGQLQLKIGRDWVPLSPGMKCTQEEVDLNLLRYTHTGAMDSQNQDSFTFYLWDGNNRSPALDCQITIKDMEKGDIVILTKPLVVSKGDRGFLTTTTLLAVDGTDKPEELLYVITSPPRYGQIEYVHYPGVPITNFSQMDVVGQTVCYVHKSKVTVSSDRFRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSQRSKLGKSCVLVQRQGKWQTKDCRRAKPHNYVCSRKL

SEQ ID NO: 46682 - protein, 215 aa, Homo sapiens
MLDESLAVRRSKKCKEMIMHWEKKEDIDIVNTVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDP

SEQ ID NO: 46683 - protein, 715 aa, Homo sapiens
MVTQESMLKAALPLFTRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSQRSKLGKSCVLVQRQGKWQTKDCRRAKPHNYVCSRKL

SEQ ID NO: 46684 - protein, 2179 aa, Homo sapiens; identical to SEQ ID NO: 46680

SEQ ID NO: 46685 - protein, 3169 aa, Homo sapiens
MHSAGTPGLSSRRTGNSTSFQPGPPPPPRLLLLLLLLLSLVSRVPAQPAAFGRALLSPGLAGAAGVPAEEAIVLANRGLRVPFGREVWLDPLHDLVLQVQPGDRCAVSVLDNDALAQRPGRLSPKRFPCDFGPGEVRYSHLGARSPSRDRVRLQLRYDAPGGAVVLPLVLEVEVVFTQLEVVTRNLPLVVEELLGTSNALDARSLEFAFQPETEECRVGILSGLGALPRYGELLHYPQVPGGAREGGAPETLLMDCKAFQELGVRYRHTAASRSPNRDWIPMVVELRSRGAPVGSPALKREHFQVLVRIRGGAENTAPKPSFVAMMMMEVDQFVLTALTPDMLAAEDAESPSDLLIFNLTSPFQPGQGYLVSTDDRSLPLSSFTQRDLRLLKIAYQPPSEDSDQERLFELELEVVDLEGAASDPFAFMVVVKPMNTMAPVVTRNTGLILYEGQSRPLTGPAGSGPQNLVISDEDDLEAVRLEVVAGLRHGHLVILGASSGSSAPKSFTVAELAAGQVVYQHDDRDGSLSDNLVLRMVDGGGRHQVQFLFPITLVPVDDQPPVLNANTGLTLAEGETVPILPLSLSATDMDSDDSLLLFVLESPFLTTGHLLLRQTHPPHEKQELLRGLWRKEGAFYERTVTEWQQQDITEGRLFYRHSGPHSPGPVTDQFTFRVQDNHDPPNQSGLQRFVIRIHPVDRLPPELGSGCPLRMVVQESQLTPLRKKWLRYTDLDTDDRELRYTVTQSPTDTDENHLPAPLGTLVLTDNPSVVVTHFTQAQINHHKIAYRPPGQELGVATRVAQFQFQVEDRAGNVAPGTFTLYLHPVDNQPPEILNTGFTIQEKGHHILSETELHVNDVDTDVAHISFTLTQAPKHGHMRVSGQILHVGGLFHLEDIKQGRVSYAHNGDKSLTDSCSLEVSDRHHVVPITLRVNVRPVDDEVPILSHPTGTLESYLDVLENGATEITANVIKGTNEETDDLMLTFLLEDPPLYGEILVNGIPAEQFTQRDILEGSVVYTHTSGEIGLLPKADSFNLSLSDMSQEWRIGGNTIQGVTIWVTILPVDSQAPEIFVGEQLIVMEGDKSVITSVHISAEDVDSLNDDILCTIVIQPTSGYVENISPAPGSEKSRAGIAISAFNLKDLRQGHINYVQSVHKGVEPVEDRFVFRCSDGINFSERQFFPIVIIPTNDEQPEMFMREFMVMEGMSLVIDTPILNAADADVPLDDLTFTITQFPTHGHIMNQLINGTVLVESFTLDQIIESSSIIYEHDDSETQEDSFVIKLTDGKHSVEKTVLIIVIPVDDETPRMTINNGLEIEIGDTKIINNKILMATDLDSEDKSLVYIIRYGPGHGLLQRRKPTGAFENITLGMNFTQDEVDRNLIQYVHLGQEGIRDLIKFDVTDGINPLIDRYFYVSIGSIDIVFPDVISKGVSLKEGGKVTLTTDLLSTSDLNSPDENLVFTITRAPMRGHLECTDQPGVSITSFTQLQLAGNKIYYIHTADDEVKMDSFEFQVTDGRNPVFRTFRISISDVDNKKPVVTIHKLVVSESENKLITPFELTVEDRDTPDKLLKFTITQVPIHGHLLFNNTRPVMVFTKQDLNENLISYKHDGTESSEDSFSFTVTDGTHTDFYVFPDTVFETRRPQVMKIQVLAVDNSVPQIAVNKGASTLRTLATGHLGFMITSKILKVEDRDSLHISLRFIVTEAPQHGYLLNLDKGNHSITQFTQADIDDMKICYVLREGANATSDMFYFAVEDGGGNKLTYQNFRLNWAWISFEKEYYLVNEDSKFLDVVLKRRGYLGETSFISIGTRDRTAEKDKDFKGKAQKQVQFNPGQTRATWRVRILSDGEHEQSETFQVVLSEPVLAALEFPTVATVEIVDPGDEPTVFIPQSKYSVEEDVGELFIPIRRSGDVSQELMVVCYTQQGTATGTVPTSVLSYSDYISRPEDHTSVVRFDKDEREKLCRIVIIDDSLYEEEETFHVLLSMPMGGRIGSEFPGAQVTIVPDKDDEPIFYFGDVEYSVDESAGYVEVQVWRTGTDLSKSSSVTVRSRKTDPPSADAGTDYVGISRNLDFAPGVNMQPVRVVILDDLGQPALEGIEKFELVLRMPMNAALGEPSKATVSINDSVSDLPKMQFKERIYTGSESDGQIVTMIHRTGDVQYRSSVRCYTRQGSAQVMMDFEERPNTDTSIITFLPGETEKPCILELMDDVLYEEVEELRLVLGTPQSNSPFGAAVGEQNETLIRIRDDADKTVIKFGETKFSVTEPKEPGESVVIRIPVIRQGDTSKVSIVRVHTKDGSATSGEDYHPVSEEIEFKEGETQHVVEIEVTFDGVREMREAFTVHLKPDENMIAEMQLTKAIVYIEEMSSMADVTFPSVPQIVSLLMYDDTSKAKESAEPMSGYPVICITACNPKYSDYDKTGSICASENINDTLTRYRWLISAPAGPDGVTSPMREVDFDTFFTSSKMVTLDSIYFQPGSRVQCAARAVNTNGDEGLELMSPIVTISREEGLCQPRVPGVVGAEPFSAKLRYTGPEDADYTNLIKLTVTMPHIDGMLPVISTRELSNFELTLSPDGTRVGNHKCSNLLDYTEVKTHYGFLTDATKNPEIIGETYPYQYSLSIRGSTTLRFYRNLNLEACLWEFVSYYDMSELLADCGGTIGTDGQVLNLVQSYVTLRVPLYVSYVFHSPVGVGGWQHFDLKSELRLTFVYDTAILWNDGIGSPPEAELQGSLYPTSMRIGDEGRLAVHFKTEAQFHGLFVLSHPASFTSSVIMSADHPGLTFSLRLIRSEPTYNQPVQQWSFVSDFAVRDYSGTYTVKLVPCTAPSHQEYRLPVTCNPREPVTFDLDIRFQQVSDPVAAEFSLNTQMYLLSKKSLWLSDGSMGFGQESDVAFAEGDIIYGRVMVDPVQNLGDSFYCSIEKVFLCTGADGYVPKYSPMNAEYGCLADSPSLLYRFKIVDKAQPETQATSFGNVLFNAKLAVDDPEAILLVNQPGSDGFKVDSTPLFQVALGREWYIHTIYTVRSKDNANRGIGKRSVEYHSLVSQGKPQSTTKSRKKREIRSTPSLAWEIGAENSRGTNIQHIALDRTKRQIPHGRAPPDGILPWELNSPSSAVSLVTVVGGTTVGLLTICLTVIAVLMCRGKESFRGKDAPKGSSSSEPMVPPQSHHNDSSEV

SEQ ID NO: 46686 - protein, 4012 aa, Homo sapiens
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIERKNDEPPRMTLQPLRVQLSSGVVISNSSLSLQDLDTPDNELIFVLTKKPDHGHVLWRQTASEPLENGRVLVQGSTFTYQDILAGLVGYVPSVPGMVVDEFQFSLTDGLHVDTGRMKIYTELPASDTPHLAINQGLQLSAGSVARITEQHLKVTDIDSDDHQVMYIMKEDPGAGRLQMMKHGNLEQISIKGPIRSFTQADISQGHVEYSHGTGEPGGSFAFKFDVVDGEGNRLIDKSFSISILEDKSPPVITTNKGLVLDENSVKKITTLQLSATDQDSGPTELIYRITRQPQLGHLEHAASPGIQISSFTQADLTSRNVQYVHSSEAEKHSDAFSFTLSDGVSEVTQTFHITLHPVDDSLPVVQNLGMRVQEGMRKTITEFELKAVDADTEAESVTFTIVQPPRHGTIERTSNGQHFHLTSTFTMKDIYQNRVSYSHDGSNSLKDRFTFTVSDGTNPFFIIEEGGKEIMTAAPQPFRVDILPVDDGTPRIVTNLGLQWLEYMDGKATNLITKKELLTMDPDTEDAQLVYEITTGPKHGFVENKLQPGRAAATFTQEDVNLGLIRYVLHKEKIREMMDSFQFLVKDSKPNVVSDNVFHIQWSLISFKYTSYNVSEKAGSVSVTVQRTGNLNQYAIVLCRTEQGTASSSSRVSSQPGQQDYVEYAGQVQFDEREDTKSCTIVINDDDVFENVESFTVELSMPAYALLGEFTQAKVIINDTEDEPTLEFDKKIYWVNESAGFLFAPIERKGDASSIVSAICYTVPKSAMGSSLYALESGSDFKSRGMSAASRVIFGPGVTMSTCDVMLIDDSEYEEEEEFEIALADASDNARIGRVATAKVLISGPNDASTVSLGNTAFTVSEDAGTVKIPVIRHGTDLSTFASVWCATRPSDPASATPGVDYVPSSRKVEFGPGVIEQYCTLTILDDTQYPVIEGLETFVVFLSSAQGAELTKPFQAVIAINDTFQDVPSMQFAKDLLLVKEKEGVLHVPITRSGDLSYESSVRCYTQSHSAQVMEDFEERQNADSSRITFLKGDKVKNCTVYIHDDSMFEPEEQFRVYLGLPLGNHWSGARIGKNNMATITISNDEDAPTIEFEEAAYQVREPAGPDAIAILNIKVIRRGDQNRTSKVRCSTRDGSAQSGVDYYPKSRVLKFSPGVDHIFFKVEILSNEDREWHESFSLVLGPDDPVEAVLGDVTTATVTILDQEAAGSLILPAPPIVVTLADYDHVEEVTKEGVKKSPSPGYPLVCVTPCDPHFPRYAVMKERCSEAGINQTSVQFSWEVAAPTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGISEAGFLDDVVYDSTALGPGYDRPFQFDPSVREPKTIQLYKHLNLKSCVWTFDAYYDMTELIDVCGGSVTADFQVRDSAQSFLTVHVPLYVSYIYVTAPRGWASLEHHTEMEFSFFYDTVLWRTGIQTDSVLSARLQIIRIYIREDGRLVIEFKTHAKFRGQFVMEHHTLPEVKSFVLTPDHLGGIEFDLQLLWSAQTFDSPHQLWRATSSYNRKDYSGEYTIYLIPCTVQPTQPWVDPGEKPLACTAHAPERFLIPIAFQQTNRPVPVVYSLNTEFQLCNNEKVFLMDPNTSDMSLAEMDYKGAFSKGQILYGRVLWNPEQNLNSAYKLQLEKVYLCTGKDGYVPFFDPTGTIYNEGPQYGCIQPNKHLKHRFLLLDRNQPEVTDKYFHDVPFEAHFASELPDFHVVSNMPGVDGFTLKVDALYKVEAGHQWYLQVIYIIGPDTISGPRVQRSLTAPLRRNRRDLVEPDGQLILDDSLIYDNEGDQVKNGTNMKSLNLEMQELAVAASLSQTGASIGSALAAIMLLLLVFLVACFINRKCQKQRKKKPAEDILEEYPLNTKVEVPKRHPDRVEKNVNRHYCTVRNVNILSEPEAAYTFKGAKVKRLNLEVRVHNNLQDGTEV

SEQ ID NO: 46687 - protein, 737 aa, Homo sapiens
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEGQNLDFCQNLEVISAVCLGISSTEN

SEQ ID NO: 46688 - protein, 317 aa, Homo sapiens
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPALASQSVGITGMSHHAQSLLGPFLTQIKKPHFSCLE

SEQ ID NO: 46689 - protein, 2241 aa, Homo sapiens
  MOD_RES (1)..(1): Any amino acid
XSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIERKNDEPPRMTLQPLRVQLSSGVVISNSSLSLQDLDTPDNELIFVLTKKPDHGHVLWRQTASEPLENGRVLVQGSTFTYQDILAGLVGYVPSVPGMVVDEFQFSLTDGLHVDTGRMKIYTELPASDTPHLAINQGLQLSAGSVARITEQHLKVTDIDSDDHQVMYIMKEDPGAGRLQMMKHGNLEQISIKGPIRSFTQADISQGHVEYSHGTGEPGGSFAFKFDVVDGEGNRLIDKSFSISILEDKSPPVITTNKGLVLDENSVKKITTLQLSATDQDSGPTELIYRITRQPQLGHLEHAASPGIQISSFTQADLTSRNVQYVHSSEAEKHSDAFSFTLSDGVSEVTQTFHITLHPVDDSLPVVQNLGMRVQEGMRKTITEFELKAVDADTEAESVTFTIVQPPRHGTIERTSNGQHFHLTSTFTMKDIYQNRVSYSHDGSNSLKDRFTFTVSDGTNPFFIIEEGGKEIMTAAPQPFRVDILPVDDGTPRIVTNLGLQWLEYMDGKATNLITKKELLTMDPDTEDAQLVYEITTGPKHGFVENKLQPGRAAATFTQEDVNLGLIRYVLHKEKIREMMDSFQFLVKDSKPNVVSDNVFHIQWSLISFKYTSYNVSEKAGSVSVTVQRTGNLNQYAIVLCRTEQGTASSSSRVSSQPGQQDYVEYAGQVQFDEREDTKSCTIVINDDDVFENVESFTVELSMPAYALLGEFTQAKVIINDTEDEPTLEFDKKIYWVNESAGFLFAPIERKGDASSIVSAICYTVPKSAMGSSLYALESGSDFKSRGMSAASRVIFGPGVTMSTCDVMLIDDSEYEEEEEFEIALADASDNARIGRVATAKVLISGPNDASTVSLGNTAFTVSEDAGTVKIPVIRHGTDLSTFASVWCATRPSDPASATPGVDYVPSSRKVEFGPGVIEQYCTLTILDDTQYPVIEGLETFVVFLSSAQGAELTKPFQAVIAINDTFQDVPSMQFAKDLLLVKEKEGVLHVPITRSGDLSYESSVRCYTQSHSAQVMEDFEERQNADSSRITFLKGDKVKNCTVYIHDDSMFEPEEQFRVYLGLPLGNHWSGARIGKNNMATITISNDEDAPTIEFEEAAYQVREPAGPDAIAILNIKVIRRGDQNRTSKVRCSTRDGSAQSGVDYYPKSRVLKFSPGVDHIFFKVEILSNEDREWHESFSLVLGPDDPVEAVLGDVTTATVTILDQEAAGSLILPAPPIVVTLADYDHVEEVTKEGVKKSPSPGYPLVCVTPCDPHFPRYAVMKERCSEAGINQTSVQFSWEVAAPTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGISEAGFLDDVVYDSTALGPGYDRPFQFDPSVREPKTIQLYKHLNLKSCVWTFDAYYDMTELIDVCGGSVTADFQVRDSAQSFLTVHVPLYVSYIYVTAPRGWASLEHHTEMEFSFFYDTVLWRTGIQTDSVLSARLQIIRIYIREDGRLVIEFKTHAKFRGQFVMEHHTLPEVKSFVLTPDHLGGIEFDLQLLWSAQTFDSPHQLWRATSSYNRKDYSGEYTIYLIPCTVQPTQPWVDPGEKPLACTAHAPERFLIPIAFQQTNRPVPVVYSLNTEFQLCNNEKVFLMDPNTSDMSLAEMDYKGAFSKGQILYGRVLWNPEQNLNSAYKLQLEKVYLCTGKDGYVPFFDPTGTIYNEGPQYGCIQPNKHLKHRFLLLDRNQPEVTDKYFHDVPFEAHFASELPDFHVVSNMPGVDGFTLKVDALYKVEAGHQWYLQVIYIIGPDTISGPRVQRSLTAPLRRNRRDLVEPDGQLILDDSLIYDNEGDQVKNGTNMKSLNLEMQELAVAASLSQTGASIGSALAAIMLLLLVFLVACFINRKCQKQRKKKPAEDILEEYPLNTKVEVPKRHPDRVEKNVNRHYCTVRNVNILSEPEAAYTFKGAKVKRLNLEVRVHNNLQDGTEV

SEQ ID NO: 46690 - protein, 255 aa, Homo sapiens
ERQGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLDDGFSLPAPVLHVYQWAGVLILPASPADAARAVCAYLWGRLLPRSPFLC

SEQ ID NO: 46691 - protein, 279 aa, Homo sapiens
MVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFCY

SEQ ID NO: 46692 - protein, 1976 aa, Homo sapiens
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIEVKTLEVGKVEPLTTIFHTIRELSL

SEQ ID NO: 46693 - protein, 210 aa, Homo sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSSGPKRYDWTGKNWVYSHDGVSLHELLAAELTKALKTKLDLSSLAYSGKDA

SEQ ID NO: 46694 - protein, 171 aa, Homo sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSRLTWLLWLFHP

SEQ ID NO: 46695 - protein, 196 aa, Homo sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSRYVVDLSVMTGLGKTGCTPTTACPSMSCWPQSSLKP

SEQ ID NO: 46696 - protein, 233 aa, Homo sapiens
MPCRREEEEEAGEEAEGEEEEDDSFLLLQQSVTLGSSGEVDRLVAQIGETLQLDAAQDSPASPCAPPGVPLRAPGPLAAAVPADKARPPAVPLLLPPASAETVGPAPSGALRCALGDRGRVRGRAAPYCVAEVAAGPSALPGPCRRGWLRDAVTSRRLQQRRWTQAGARAGDDDPHRLLQQLVLSGNLIKEAVRRLQRAVAAVAATGPASAPGPGGGRSGPDRIALQPSGSLL

SEQ ID NO: 46697 - protein, 386 aa, Homo sapiens
MEGGLAGERARESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 46698 - protein, 419 aa, Homo sapiens
MTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 46699 - protein, 452 aa, Homo sapiens
MDGTIKEALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 46700 - protein, 259 aa, Homo sapiens
MDPGSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 46701 - protein, 647 aa, Homo sapiens
MAEEEAPKKSRAAGGGASWELCAGALSARLAEEGSGDAGGRRRPPVDPRRLARQLLLLLWLLEAPLLLGVRAQAAGQGPGQGPGPGQQPPPPPQQQQSGQQYNGERGISVPDHGYCQPISIPLCTDIAYNQTIMPNLLGHTNQEDAGLEVHQFYPLVKVQCSAELKFFLCSMYAPVCTVLEQALPPCRSLCERARQGCEALMNKFGFQWPDTLKCEKFPVHGAGELCVGQNTSDKGTPTPSLLPEFWTSNPQHGGGGHRGGFPGGAGASERGKFSCPRALKVPSYLNYHFLGEKDCGAPCEPTKVYGLMYFGPEELRFSRTWIGIWSVLCCASTLFTVLTYLVDMRRFSYPERPIIFLSGCYTAVAVAYIAGFLLEDRVVCNDKFAEDGARTVAQGTKKEGCTILFMMLYFFSMASSIWWVILSLTWFLAAGMKWGHEAIEANSQYFHLAAWAVPAIKTITILALGQVDGDVLSGVCFVGLNNVDALRGFVLAPLFVYLFIGTSFLLAGFVSLFRIRTIMKHDGTKTEKLEKLMVRIGVFSVLYTVPATIVIACYFYEQAFRDQWERSWVAQSCKSYAIPCPHLQAGGGAPPHPPMSPDFTVFMIKYLMTLIVGITSGFWIWSGKTLNSWRKFYTRLTNSKQGETTV

SEQ ID NO: 46702 - protein, 581 aa, Homo sapiens
MQRPGPRLWLVLQVMGSCAAISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKRFAVVWLAIWAVLCFFSSAFTVLTFLIDPARFRYPERPIIFLSMCYCVYSVGYLIRLFAGAESIACDRDSGQLYVIQEGLESTGCTLVFLVLYYFGMASSLWWVVLTLTWFLAAGKKWGHEAIEANSSYFHLAAWAIPAVKTILILVMRRVAGDELTGVCYVGSMDVNALTGFVLIPLACYLVIGTSFILSGFVALFHIRRVMKTGGENTDKLEKLMVRIGLFSVLYTVPATCVIACYFYERLNMDYWKILAAQHKCKMNNQTKTLDCLMAASIPAVEIFMVKIFMLLVVGITSGMWIWTSKTLQSWQQVCSRRLKKKSRRKPASVITSGGIYKKAQHPQKTHHGKYEIPAQSPTCV

SEQ ID NO: 46703 - protein, 454 aa, Homo sapiens
MPAHRDPDVQGHRLQHDSYAQPDGPREPARGSHPVARVRAAGGVRLPRPPPLLPVLAVRADVHRAGLYPHPRLPGHVRAGPAQVLPDYGAVQLQVARLPGLPETPQQERPQLPVHGGAQQRLGRAHPGLGPVPAAVPAAAAPQRAGAPAEGRGPRARRLRQPGQVPPRGEERVVRAALHARRGRVLEPRGQALRSGLAGHLGGAVLLLQRLHRAHLPHRPGPLPLPRAPHHLPLHVLLRLLRGLPHPPLRRRREHRLRPGQRPALCHPGGTGEHRLHAGLPGPLLLRHGQLAVVGGPHAHLVPGRRQEVGPRGHRSQQQLLPPGSLGHPGGEDHPDPGHAQGGGGRAHRGLLRGQHGRQRAHRLRAHSPGLLPGHRHVLHPLGLRGPVPHPEGDEDGRREHGQAGEAHGAYRALLCAVHRAGHLCDRLLLLRTPQHGLLEDPGGAAQVQNEQPD

SEQ ID NO: 46704 - protein, 565 aa, Homo sapiens
MRPRSALPRLLLPLLLLPAAGPAQFHGEKGISIPDHGFCQPISIPLCTDIAYNQTIMPNLLGHTNQEDAGLEVHQFYPLVKVQCSPELRFFLCSMYAPVCTVLEQAIPPCRSICERARQGCEALMNKFGFQWPERLRCEHFPRHGAEQICVGQNHSEDGAPALLTTAPPPGLQPGAGGTPGGPGGGGAPPRYATLEHPFHCPRVLKVPSYLSYKFLGERDCAAPCEPARPDGSMFFSQEETRFARLWILTWSVLCCASTFFTVTTYLVDMQRFRYPERPIIFLSGCYTMVSVAYIAGFVLQERVVCNERFSEDGYRTVVQGTKKEGCTILFMMLYFFSMASSIWWVILSLTWFLAAGMKWGHEAIEANSQYFHLAAWAVPAVKTITILAMGQIDGDLLSGVCFVGLNSLDPLRGFVLAPLFVYLFIGTSFLLAGFVSLFRIRTIMKHDGTKTEKLERLMVRIGVFSVLYTVPATIVIACYFYEQAFREHWERSWVSQHCKSLAIPCPAHYTPRMSPDFTVYMIKYLMTLIVGITSGFWIWSGKTLHSWRKFYTRLTNSRHGETTV

SEQ ID NO: 46705 - protein, 641 aa, Homo sapiens
ARGVSGCSVRPRQASGQAHRPLPRPASPTLRPRVKFAKRRGRRQPQRGGGGEEAQSPGWGRGRGGRQGAGWGAAASMRPRSALPRLLLPLLLLPAAGPAQFHGEKGISIPDHGFCQPISIPLCTDIAYNQTIMPNLLGHTNQEDAGLEVHQFYPLVKVQCSPELRFFLCSMYAPVCTVLEQAIPPCRSICERARQGCEALMNKFGFQWPERLRCEHFPRHGAEQICVGQNHSEDGAPALLTTAPPPGLQPGAGGTPGGPGGGGAPPRYATLEHPFHCPRVLKVPSYLSYKFLGERDCAAPCEPARPDGSMFFSQEETRFARLWILTWSVLCCASTFFTVTTYLVDMQRFRYPERPIIFLSGCYTMVSVAYIAGFVLQERVVCNERFSEDGYRTVVQGTKKEGCTILFMMLYFFSMASSIWWVILSLTWFLAAGMKWGHEAIEANSQYFHLAAWAVPAVKTITILAMGQIDGDLLSGVCFVGLNSLDPLRGFVLAPLFVYLFIGTSFLLAGFVSLFRIRTIMKHDGTKTEKLERLMVRIGVFSVLYTVPATIVIACYFYEQAFREHWERSWVSQHCKSLAIPCPAHYTPRMSPDFTVYMIKYLMTLIVGITSGFWIWSGKTLHSWRKFYTRLTNSRHGETTV

SEQ ID NO: 46706 - protein, 666 aa, Homo sapiens
MAMTWIVFSLWPLTVFMGHIGGHSLFSCEPITLRMCQDLPYNTTFMPNLLNHYDQQTAALAMEPFHPMVNLDCSRDFRPFLCALYAPICMEYGRVTLPCRRLCQRAYSECSKLMEMFGVPWPEDMECSRFPDCDEPYPRLVDLNLAGEPTEGAPVAVQRDYGFWCPRELKIDPDLGYSFLHVRDCSPPCPNMYFRREELSFARYFIGLISIICLSATLFTFLTFLIDVTRFRYPERPIIFYAVCYMMVSLIFFIGFLLEDRVACNASIPAQYKASTVTQGSHNKACTMLFMILYFFTMAGSVWWVILTITWFLAAVPKWGSEAIEKKALLFHASAWGIPGTLTIILLAMNKIEGDNISGVCFVGLYDVDALRYFVLAPLCLYVVVGVSLLLAGIISLNRVRIEIPLEKENQDKLVKFMIRIGVFSILYLVPLLVVIGCYFYEQAYRGIWETTWIQERCREYHIPCPYQVTQMSRPDLILFLMKYLMALIVGIPSVFWVGSKKTCFEWASFFHGRRKKEIVNESRQVLQEPDFAQSLLRDPNTPIIRKSRGTSTQGTSTHASSTQLAMVDDQRSKAGSIHSKVSSYHGSLHRSRDGRYTPCSYRGMEERLPHGSMSRLTDHSRHSSSHRLNEQSRHSSIRDLSNNPMTHITHGTSMNRVIEEDGTSA

SEQ ID NO: 46707 - protein, 35 aa, Homo sapiens
MAMTWIVFSLWPLTVFMGHIGGHSLFSCEPITLRM

SEQ ID NO: 46708 - protein, 666 aa, Homo sapiens; identical to SEQ ID NO: 46706

SEQ ID NO: 46709 - protein, 537 aa, Homo sapiens
MAWRGAGPSVPGAPGGVGLSLGLLLQLLLLLGPARGFGDEEERRCDPIRISMCQNLGYNVTKMPNLVGHELQTDAELQLTTFTPLIQYGCSSQLQFFLCSVYVPMCTEKINIPIGPCGGMCLSVKRRCEPVLKEFGFAWPESLNCSKFPPQNDHNHMCMEGPGDEEVPLPHKTPIQPGEECHSVGTNSDQYIWVKRSLNCVLKCGYDAGLYSRSAKEFTDIWMAVWASLCFISTAFTVLTFLIDSSRFSYPERPIIFLSMCYNIYSIAYIVRLTVGRERISCDFEEAAEPVLIQEGLKNTGCAIIFLLMYFFGMASSIWWVILTLTWFLAAGLKWGHEAIEMHSSYFHIAAWAIPAVKTIVILIMRLVDADELTGLCYVGNQNLDALTGFVVAPLFTYLVIGTLFIAAGLVALFKIRSNLQKDGTKTDKLERLMVKIGVFSVLYTVPATCVIACYFYEISNWALFRYSADDSNMAVEMLKIFMSLLVGITSGMWIWSAKTLHTWQKCSNRLVNSGKVKREKRGNGWVKPGKGSETVV

SEQ ID NO: 46710 - protein, 706 aa, Homo sapiens
MEMFTFLLTCIFLPLLRGHSLFTCEPITVPRCMKMAYNMTFFPNLMGHYDQSIAAVEMEHFLPLANLECSPNIETFLCKAFVPTCIEQIHVVPPCRKLCEKVYSDCKKLIDTFGIRWPEELECDRLQYCDETVPVTFDPHTEFLGPQKKTEQVQRDIGFWCPRHLKTSGGQGYKFLGIDQCAPPCPNMYFKSDELEFAKSFIGTVSIFCLCATLFTFLTFLIDVRRFRYPERPIIYYSVCYSIVSLMYFIGFLLGDSTACNKADEKLELGDTVVLGSQNKACTVLFMLLYFFTMAGTVWWVILTITWFLAAGRKWSCEAIEQKAVWFHAVAWGTPGFLTVMLLAMNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQESCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 46711 - protein, 706 aa, Homo sapiens; identical to SEQ ID NO: 46710

SEQ ID NO: 46712 - protein, 674 aa, Homo sapiens
MKMAYNMTFFPNLMGHYDQSIAAVEMEHFLPLANLECSPNIETFLCKAFVPTCIEQIHVVPPCRKLCEKVYSDCKKLIDTFGIRWPEELECDRLQYCDETVPVTFDPHTEFLGPQKKTEQVQRDIGFWCPRHLKTSGGQGYKFLGIDQCAPPCPNMYFKSDELEFAKSFIGTVSIFCLCATLFTFLTFLIDVRRFRYPERPIIYYSVCYSIVSLMYFIGFLLGDSTACNKADEKLELGDTVVLGSQNKACTVLFMLLYFFTMAGTVWWVILTITWFLAAGRKWSCEAIEQKAVWFHAVAWGTPGFLTVMLLAMNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQESCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 46713 - protein, 651 aa, Homo sapiens
MLAQHFLPLANLECSPNIETFLCKAFVPTCIEQIHVVPPCRKLCEKVYSDCKKLIDTFGIRWPEELECDRLQYCDETVPVTFDPHTEFLGPQKKTEQVQRDIGFWCPRHLKTSGGQGYKFLGIDQCAPPCPNMYFKSDELEFAKSFIGTVSIFCLCATLFTFLTFLIDVRRFRYPERPIIYYSVCYSIVSLMYFIGFLLGDSTACNKADEKLELGDTVVLGSQNKACTVLFMLLYFFTMAGTVWWVILTITWFLAAGRKWSCEAIEQKAVWFHAVAWGTPGFLTVMLLAMNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQESCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 46714 - protein, 401 aa, Homo sapiens
MTRVLPRWKWSCEAIEQKAVWFHAVAWGTPGFLTVMLLAMNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQESCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 46715 - protein, 694 aa, Homo sapiens
MEWGYLLEVTSLLAALALLQRSSGAAAASAKELACQEITVPLCKGIGYNYTYMPNQFNHDTQDEAGLEVHQFWPLVEIQCSPDLKFFLCSMYTPICLEDYKKPLPPCRSVCERAKAGCAPLMRQYGFAWPDRMRCDRLPEQGNPDTLCMDYNRTDLTTAAPSPPRRLPPPPPGEQPPSGSGHGRPPGARPPHRGGGRGGGGGDAAAPPARGGGGGGKARPPGGGAAPCEPGCQCRAPMVSVSSERHPLYNRVKTGQIANCALPCHNPFFSQDERAFTVFWIGLWSVLCFVSTFATVSTFLIDMERFKYPERPIIFLSACYLFVSVGYLVRLVAGHEKVACSGGAPGAGGAGGAGGAAAGAGAAGAGAGGPGGRGEYEELGAVEQHVRYETTGPALCTVVFLLVYFFGMASSIWWVILSLTWFLAAGMKWGNEAIAGYSQYFHLAAWLVPSVKSIAVLALSSVDGDPVAGICYVGNQSLDNLRGFVLAPLVIYLFIGTMFLLAGFVSLFRIRSVIKQQDGPTKTHKLEKLMIRLGLFTVLYTVPAAVVVACLFYEQHNRPRWEATHNCPCLRDLQPDQARRPDYAVFMLKYFMCLVVGITSGVWVWSGKTLESWRSLCTRCCWASKGAAVGGGAGATAAGGGGGPGGGGGGGPGGGGGPGGGGGSLYSDVSTGLTWRSGTASSVSYPKQMPLSQV

SEQ ID NO: 46716 - protein, 591 aa, Homo sapiens
MAVAPLRGALLLWQLLAAGGAALEIGRFDPERGRGAAPCQAVEIPMCRGIGYNLTRMPNLLGHTSQGEAAAELAEFAPLVQYGCHSHLRFFLCSLYAPMCTDQVSTPIPACRPMCEQARLRCAPIMEQFNFGWPDSLDCARLPTRNDPHALCMEAPENATAGPAEPHKGLGMLPVAPRPARPPGDLGPGAGGSGTCENPEKFQYVEKSRSCAPRCGPGVEVFWSRRDKDFALVWMAVWSALCFFSTAFTVLTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVILTLRKVAGDELTGLCYVASTDAAALTGFVLVPLSGYLVLGSSFLLTGFVALFHIRKIMKTGGTNTEKLEKLMVKIGVFSILYTVPATCVIVCYVYERLNMDFWRLRATEQPCAAAAGPGGRRDCSLPGGSVPTVAVFMLKIFMSLVVGITSGVWVWSSKTFQTWQSLCYRKIAAGRARAKACRAPGSYGRGTHCHYKAPTVVLHMTKTDPSLENPTHL

SEQ ID NO: 46717 - protein, 325 aa, Homo sapiens
MVCGSPGGMLLLRAGLLALAALCLLRVPGARAAACEPVRIPLCKSLPWNMTKMPNHLHHSTQANAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPIRATQKTYFRNNYNYVIRAKVKEIKTKCHDVTAVVEVKEILKSSLVNIPRDTVNLYTSSGCLCPPLNVNEEYIIMGYEDEERSRLLLVEGSIAEKWKDRLGKKVKRWDMKLRHLGLSKSDSSNSDSTQSQKSGRNSNPRQARN

SEQ ID NO: 46718 - protein, 309 aa, Homo sapiens
MEELLRRELGCSSVRATGHSGGGCISQGRSYDTDQGRVFVKVNPKAEARRMFEGEMASLTAILKTNTVKVPKPIKVLDAPGGGSVLVMEHMDMRHLSSHAAKLGAQLADLHLDNKKLGEMRLKEAGTVGRGGGQEERPFVARFGFDVVTCCGYLPQVNDWQEDWVVFYARQRIQPQMDMVEKESGDREALQLWSALQLKIPDLFRDLEIIPALLHGDLWGGNVAEDSSGPVIFDPASFYGHSEYELAIAGMFGGFSSSFYSAYHGKIPKAPGFEKRLQLYQLFHYLNHWNHFGSGYRGSSLNIMRNLVK

SEQ ID NO: 46719 - protein, 259 aa, Homo sapiens [sequence omitted]

SEQ ID NO: 46720 - protein, 338 aa, Homo sapiens [sequence omitted]

SEQ ID NO: 46721 - protein, 151 aa, Homo sapiens
MLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYARDFDPAVTEYIQRKKFPP

SEQ ID NO: 46722 - protein, 338 aa, Homo sapiens [sequence omitted]

SEQ ID NO: 46723 - protein, 339 aa, Homo sapiens
MTDRSPFETDMLTLTRYVMEKGRQAKGTGELTQLLNSMLTAIKAISSAVRKAGLAHLYGIAGSVNVTGDEVKKLDVLSNSLVINMVQSSYSTCVLVSEENKDAIITAKEKRGKYVVCFDPLDGSSNIDCLASIGTIFAIYRKTSEDEPSEKDALQCGRNIVAAGYALYGSATLVALSTGQGVDLFMLDPALGEFVLVEKDVKIKKKGKIYSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPEAIHQRVPLILGSPEDVQEYLTCVQKNQAGS

SEQ ID NO: 46724 - protein, 278 aa, Homo sapiens
MGKGNEDSDLHCSSIQCSTDQPPFQQISFTEKGSDEKKPFKEKGKTAFSHSSEKHIQRQGSEPNPNKENSEETKLKAGNSTAGSEPESSSYRENCRKRKMSSKDSCQDTAGNCPEKECSLSLNKKSRSSTAVHNSEIQETCDAHHRGHSRACTGHSKRHRSRALGVQTPSIRKSLVTSVRAMSEAVYQDLAQVWAQQIHSPLTCEQLTLLTRLRGPLCAQVQTLYSMATQAAYVFPAESWLVPATLPGPGESALDREAHPFPGQEITETVSGSDEAKL

SEQ ID NO: 46725 - protein, 327 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIEAFAVCQGYDPPEGFIPDLSKPLLDHSYDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 46726 - protein, 329 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 46727 - protein, 192 aa, Homo sapiens
MALNIATHVLKPGGCFVAKIFRGRDVTLLYSQLQVFFSSVLCAKPRSSRNSSIEAFAVCQGYDPPEGFIPDLSKPLLDHSYDPDFNQLDGPTRIIVPFVTCGDLSSYDSDRSYPLDLEGGSEYKYTPPTQPPISPPYQEACTLKRKGQLAKEIRPQDCPISRVDTFPQPLAAPQCHTLLAPEMEDNEMSCSP

SEQ ID NO: 46728 - protein, 327 aa, Homo sapiens; identical to SEQ ID NO: 46725

SEQ ID NO: 46729 - protein, 246 aa, Homo sapiens
MAGYLKLVCVSFQRQGFHTVGSRCKNRTGAEHLWLTRHLRDPFVKAAKVESYRCRSAFKLLEVNERHQILRPGLRVLDCGAAPGAWSQVAVQKVNAAGTDPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 46730 - protein, 145 aa, Homo sapiens
MAGYLKLVCVSFQRQGFHTVGSRCKNRTGAEHLWLTRHLRDPFVKAAKVESYRCRSAFKLLEVNERHQILRPGLRVLDCGAAPGAWSQVAVQKVNAAGTDGVSLLPRLQCNGVISAHCNLCLPGSSDSPASASQIPALLLASCLG

SEQ ID NO: 46731 - protein, 255 aa, Homo sapiens
MPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 46732 - protein, 466 aa, Homo sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 46733 - protein, 467 aa, Homo sapiens
MRPQELPRLAFPLLLLLLLLLPPPPCPAHSATRFDPTWESLDARQLPAWFDQAKFGIFIHWGVFSVPSFGSEWFWWYWQKEKIPKYVEFMKDNYPPSFKYEDFGPLFTAKFFNANQWADIFQASGAKYIVLTSKHHEGFTLWGSEYSWNWNAIDEGPKRDIVKELEVAIRNRTDLRFGLYYSLFEWFHPLFLEDESSSFHKRQFPVSKTLPELYELVNNYQPEVLWSDGDGGAPDQYWNSTGFLAWLYNESPVRGTVVTNDRWGAGSICKHGGFYTCSDRYNPGHLLPHKWENCMTIDKLSWGYRREAGISDYLTIEELVKQLVETVSCGGNLLMNIGPTLDGTISVVFEERLRQMGSWLKVNGEAIYETHTWRSQNDTVTPDVWYTSKPKEKLVYAIFLKWPTSGQLFLGHPKAILGATEVKLLGHGQPLNWISLEQNGIMVELPQLTIHQMPCKWGWALALTNVI

SEQ ID NO: 46734 - protein, 165 aa, Homo sapiens
MRPQELPRLAFPLLLLLLLLLPPPPCPAHSATRFDPTWESLDARQLPAWFDQAKFGIFIHWGVFSVPSFGSEWFWWYWQKEKIPKYVEFMKDNYPPSFKYEDFGPLFTAKFFNANQWADIFQASGAKYIVLTSKHHEATCRDSFMWRKSFDEYWAHTRWHHFCSF

SEQ ID NO: 46735 - protein, 165 aa, Homo sapiens; identical to SEQ ID NO: 46734

SEQ ID NO: 46736 - protein, 109 aa, Homo sapiens
QLVETVSCGGNLLMNIGPTLDGTISVVFEERLRQMGSWLKVNGEAIYETHTWRSQNDTVTPDVWYTSKPKEKLVYAIFLKWPTSGQLFLGHPKAILGATEVRGNFTLFL

SEQ ID NO: 46737 - protein, 365 aa, Homo sapiens
MWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 46738 - protein, 355 aa, Homo sapiens
MWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 46739 - protein, 343 aa, Homo sapiens
MLVVQMPFSFPMAHFILFVFTVSTIFHVQQRLAKIQAMWELPVQIPVLASTSKALGPSQLRGMWTINAIGRLGNQMGEYATLYALAKMNGRPAFIPAQMHSTLAPIFRITLPVLHSATASRIPWQNYHLNDWMEEEYRHIPGEYVRFTGYPCSWTFYHHLRQEILQEFTLHDHVREEAQKFLRGLQVNGSRPGTFVGVHVRRGDYVHVMPKVWKGVVADRRYLQQALDWFRARYSSLIFVVTSNGMAWCRENIDTSHGDVVFAGDGIEGSPAKDFALLTQCNHTIMTIGTFGIWAAYLTGGDTIYLANYTLPDSPFLKIFKPEAAFLPEWTGIAADLSPLLKH

SEQ ID NO: 46740 - protein, 343 aa, Homo sapiens; identical to SEQ ID NO: 46739

SEQ ID NO: 46741 - protein, 220 aa, Homo sapiens
MLVVQMPFSFPMAHFILFVFTVSTIFHVQQRLAKIQAMWELPVQIPVLASTSKALGPSQLRGMWTINAIGRLGNQMGEYATLYALAKMNGRPAFIPAQMHSTLAPIFRITLPVLHSATASRIPWQNYHLNDWMEEEYRHIPGEYVRFTGYPCSWTFYHHLRQEILQEFTLHDHVREEAQKFLRGLQVNGSRPGTFVGVHVRRGDYVHVMPKVWKGVVADR

SEQ ID NO: 46742 - protein, 361 aa, Homo sapiens
MDPLGAAKPQWPWRRCLAALLFQLLVAVCFFSYLRVSRDDATGSPRAPSGSSRQDTTPTRPTLLILLRTWPFHIPVALSRCSEMVPGTADCHITADRKVYPQADMVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 46743 - protein, 361 aa, Homo sapiens; identical to SEQ ID NO: 46742

SEQ ID NO: 46744 - protein, 361 aa, Homo sapiens; identical to SEQ ID NO: 46742

SEQ ID NO: 46745 - protein, 361 aa, Homo sapiens; identical to SEQ ID NO: 46742

SEQ ID NO: 46746 - protein, 530 aa, Homo sapiens
MRRLWGAARKPSGAGWEKEWAEAPQEAPGAWSGRLGPGRSGRKGRAVPGWASWPAHLALAARPARHLGGAGQGPRPLHSGTAPFHSRASGERQRRLEPQLQHESRCRSSTPADAWRAEAALPVRAMGAPWGSPTAAAGGRRGWRRGRGLPWTVCVLAAAGLTCTALITYACWGQLPPLPWASPTPSRPVGVLLWWEPFGGRDSAPRPPPDCRLRFNISGCRLLTDRASYGEAQAVLFHHRDLVKGPPDWPPPWGIQAHTAEEVDLRVLDYEEAAAAAEALATSSPRPPGQRWVWMNFESPSHSPGLRSLASNLFNWTLSYRADSDVFVPYGYLYPRSHPGDPPSGLAPPLSRKQGLVAWVVSHWDERQARVRYYHQLSQHVTVDVFGRGGPGQPVPEIGLLHTVARYKFYLAFENSQHLDYITEKLWRNALLAGAVPVVLGPDRANYERFVPRGAFIHVDDFPSASSLASYLLFLDRNPAVYRRYFHWRRSYAVHITSFWDEPWCRVCQAVQRAGDRPKSIRNLASWFER

SEQ ID NO: 46747 - protein, 374 aa, Homo sapiens
MDPLGPAKPQWLWRRCLAGLLFQLLVAVCFFSYLRVSRDDATGSPRPGLMAVEPVTGAPNGSRCQDSMATPAHPTLLILLWTWPFNTPVALPRCSEMVPGAADCNITADSSVYPQADAVIVHHWDIMYNPSANLPPPTRPQGQRWIWFSMESPSNCRHLEALDGYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFHWRETLRPRSFSWALAFCKACWKLQQESRYQTVRSIAAWFT

SEQ ID NO: 46748 - protein, 374 aa, Homo sapiens; identical to SEQ ID NO: 46747

SEQ ID NO: 46749 - protein, 359 aa, Homo sapiens
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSMESPSHCWQLKAMDGYFNLTMSYRSDSDIFTPYGWLEPWSGQPAHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQEESRYQTRGIAAWFT

SEQ ID NO: 46750 - protein, 359 aa, Homo sapiens; identical to SEQ ID NO: 46749

SEQ ID NO: 46751 - protein, 365 aa, Homo sapiens
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSMESPSHCWQLKAMDGYFNLTMSYRSDSDIFTPYGWLEPWSGQPAHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQEESRSGGLIYLRTRLPEASPA

SEQ ID NO: 46752 - protein, 359 aa, Homo sapiens; identical to SEQ ID NO: 46749

SEQ ID NO: 46753 - protein, 359 aa, Homo sapiens; identical to SEQ ID NO: 46749

SEQ ID NO: 46754 - protein, 30 aa, Homo sapiens
MDPLGPAKPQWSWRCCLTTLLFQLLMAVCF

SEQ ID NO: 46755 - protein, 137 aa, Homo sapiens
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSME

SEQ ID NO: 46756 - protein, 69 aa, Homo sapiens
MDPLGPAKPQWSWRCCLTTLLFQLLMAVCFFSYLRVSQDDPTVYPNGSRFPDSTGTPAHSIPLILLWTW

SEQ ID NO: 46757 - protein, 66 aa, Homo sapiens
MDPLGPAKPQWSWRCCLTTLLFQLLMAVCFFSYLRVSQDDPTVYPNGSRFPDSTGTPAHSIPLILL

SEQ ID NO: 46758 - protein, 45 aa, Homo sapiens
MDPLGPAKPQWSWRCCLTTLLFQLLMAVCFFSYLRVSQDDPTVYP

SEQ ID NO: 46759 - protein, 342 aa, Homo sapiens
MNNAGHGPTRRLRGLGVLAGVALLAALWLLWLLGSAPRGTPAPQPTITILVWHWPFTDQPPELPSDTCTRYGIARCHLSANRSLLASADAVVFHHRELQTRRSHLPLAQRPRGQPWVWASMESPSHTHGLSHLRGIFNWVLSYRRDSDIFVPYGRLEPHWGPSPPLPAKSRVAAWVVSNFQERQLRARLYRQLAPHLRVDVFGRANGRPLCASCLVPTVAQYRFYLSFENSQHRDYITEKFWRNALVAGTVPVVLGPPRATYEAFVPADAFVHVDDFGSARELAAFLTGMNESRYQRFFAWRDRLRVRLFTDWRERFCAICDRYPHLPRSQVYEDLEGWFQA

SEQ ID NO: 46760 - protein, 575 aa, Homo sapiens
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 46761 - protein, 575 aa, Homo sapiens; identical to SEQ ID NO: 46760

SEQ ID NO: 46762 - protein, 575 aa, Homo sapiens; identical to SEQ ID NO: 46760

SEQ ID NO: 46763 - protein, 169 aa, Homo sapiens
MHRQIWHLHWTLVRYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 46764 - protein, 15 aa, Homo sapiens
MRPWTGSWRWIMLIL

SEQ ID NO: 46765 - protein, 44 aa, Homo sapiens
MRPWTGSWRWIMLILFAWGTLLFYIGGHLVRDNDHPDHSSRELS

SEQ ID NO: 46766 - protein, 46 aa, Homo sapiens
MRPWTGSWRWIMLILFAWGTLLFYIGGHLVRDNDHPDHSSRELSKI

SEQ ID NO: 46767 - protein, 41 aa, Homo sapiens
MRPWTGSWRWIMLILFAWGTLLFYIGGHLVRDNDHPDHSSR

SEQ ID NO: 46768 - protein, 30 aa, Homo sapiens
MRPWTGSWRWIMLILFAWGTLLFYIGGHLV

SEQ ID NO: 46769 - protein, 412 aa, Homo sapiens
MTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 46770 - protein, 50 aa, Homo sapiens
MRPWTGSWRWIMLILFAWGTLLFYIGGHLVRDNDHPDHSSRELSKILAKL

SEQ ID NO: 46771 - protein, 359 aa, Homo sapiens
MTSTSKGILRPFLIVCIILGCFMACLLIYIKPTNSWIFSPMESASSVLKMKNFFSTKTDYFNETTILVWVWPFGQTFDLTSCQAMFNIQGCHLTTDRSLYNKSHAVLIHHRDISWDLTNLPQQARPPFQKWIWMNLESPTHTPQKSGIEHLFNLTLTYRRDSDIQVPYGFLTVSTNPFVFEVPSKEKLVCWVVSNWNPEHARVKYYNELSKSIEIHTYGQAFGEYVNDKNLIPTISTCKFYLSFENSIHKDYITEKLYNAFLAGSVPVVLGPSRENYENYIPADSFIHVEDYNSPSELAKYLKEVDKNNKLYLSYFNWRKDFTVNLPRFWESHACLACDHVKRHQEYKSVGNLEKWFWN

SEQ ID NO: 46772 - protein, 461 aa, Homo sapiens
MSRINKNVVLALLTLTSSAFLLFQLYYYKHYLSTKNGAGLSKSKGSRIGFDSTQWRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNYLWHGHLRLKEHIDRKFVPFRKLQFGRYPGAFDRPELQQVTVDGLEVLIPKDPMHFVEEVPHSRFIECRYKEARAFFQQYLDDNTVEAVAFRKSAKELLQLAAKTLNKLGVPFWLSSGTCLGWYRQCNIIPYSKDVDLGIFIQDYKSDIILAFQDAGLPLKHKFGKVEDSLELSFQGKDDVKLDVFFFYEETDHMWNGGTQAKTGKKFKYLFPKFTLCWTEFVDMKVHVPCETLEYIEANYGKTWKIPVKTWDWKRSPPNVQPNGIWPISEWDEVIQLY

SEQ ID NO: 46773 - protein, 430 aa, Homo sapiens
MSRINKNVVLALLTLTSSAFLLFQLYYYKHYLSTKNGAGLSKSKGSRIGFDSTQWRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNYLWHGHLRLKEHIDRKFVPFRKLQFGRYPGAFDRPELQQVTVDGLEVLIPKDPMHFVEEVPHSRFIECRYKEARAFFQQYLDDNTVEAVAFRKSAKELLQLAAKTLNKLGVPFWLSSGTCLGWYRQCNIIPYSKDVDLGIFIQDYKSDIILAFQDAGLPLKHKFGKVEDSLELSFQGKDDVKLDVFFFYEETDHMWNGGTQAKTGKKFKYLFPKFTLCWTEFVDMKVHVPCETLEYIEANYGKNQQGA

SEQ ID NO: 46774 - protein, 235 aa, Homo sapiens
MILEVGENNGFFSKSLLPRYASKKLKSSLPHSRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNYLWHGHLRLKEHIDRKFVPFRKLQFGRYPGAFDRPELQQVTVDGLEVLIPKDPMHFVEEVPHSRFIECRYKEARAF

SEQ ID NO: 46775 - protein, 183 aa, Homo sapiens
MSRINKNVVLALLTLTSSAFLLFQLYYYKHYLSTKNGAGLSKSKGSRIGFDSTQWRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNY

SEQ ID NO: 46776 - protein, 160 aa, Homo sapiens
  MOD_RES (1)..(1): Any amino acid
XWYRQCNIIPYSKDVDLGIFIQDYKSDIILAFQDAGLPLKHKFGKVEDSLELSFQGKDDVKLDVFFFYEETDHMWNGGTQAKTGKKFKYLFPKFTLCWTEFVDMKVHVPCETLEYIEANYGKEAESYILSMLFRTTFWSLADFPLTPENNSSLKNGNLNV

SEQ ID NO: 46777 - protein, 271 aa, Homo sapiens
MSRINKNVVLALLTLTSSAFLLFQLYYYKHYLSTKNGAGLSKSKGSRIGFDSTQWRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNYLWHGHLRLKEHIDRKFVPFRKLQFGRYPGAFDRPELQQVTVDGLEVLIPKDPMHFVEEVPHSRFIECRYKEARAFFQIPVSEVYTVLD

SEQ ID NO: 46778 - protein, 495 aa, Homo sapiens
MRLTRCQAALAAAITLNLLVLFYVSWLQHQPRNSRARGPRRASAAGPRVTVLVREFEAFDNAVPELVDSFLQQDPAQPVVVAADTLPYPPLALPRIPNVRLALLQPALDRPAAASRPETYVATEFVALVPDGARAEAPGLLERMVEALRAGSARLVAAPVATANPARCLALNVSLREWTARYGAAPAAPRCDALDGDAVVLLRARDLFNLSAPLARPVGTSLFLQTALRGWAVQLLDLTFAAARQPPLATAHARWKAEREGRARRAALLRALGIRLVSWEGGRLEWFGCNKETTRCFGTVVGDTPAYLYEERWTPPCCLRALRETARYVVGVLEAAGVRYWLEGGSLLGAARHGDIIPWDYDVDLGIYLEDVGNCEQLRGAEAGSVVDERGFVWEKAVEGDFFRVQYSESNHLHVDLWPFYPRNGVMTKDTWLDHRQDVEFPEHFLQPLVPLPFAGFVAQAPNNYRRFLELKFGPGVIENPQYPNPALLSLTGSG

SEQ ID NO: 46779 - protein, 495 aa, Homo sapiens; identical to SEQ ID NO: 46778

SEQ ID NO: 46780 - protein, 794 aa, Homo sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 46781 - protein, 69 aa, Homo sapiens
KPAHLNANDWATNGVGRKVSHSYGYGLWTQAPWWPWPRIGPQWPPSGSASSTSSPSPKTSGNGSRCGRP

SEQ ID NO: 46782 - protein, 69 aa, Homo sapiens
MELRPWLLWVVAATGTLVLLAADAQGQKVFTNTWAVRIPGGPAVANSVARKHGFLNLGQIFGDYYHFWH

SEQ ID NO: 46783 - protein, 526 aa, Homo sapiens
MASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 46784 - protein, 151 aa, Homo sapiens
MNPEVVEVAVEAEVAWAEVTVVASINLVALGTKDHVMTPTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAG

SEQ ID NO: 46785 - protein, 429 aa, Homo sapiens
MASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGDRGGFGPGKMDSRGEHRQDRRERPY

SEQ ID NO: 46786 - protein, 418 aa, Homo sapiens
MGEEGTGGTVHLLCLAASSGVPLFCRSSRGGAPARQQLPFSVIGSLNGVHMFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 46787 - protein, 236 aa, Homo sapiens
MGEEGTGGTVHLLCLAASSGVPLFCRSSRGGAPARQQLPFSVIGSLNGVHMFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQVLGMLWKLLHLFCWPWLSPHPLSSGPLSQPPPILSASSPIPTWSQKNLFSFFFSFLSLSFLFSFLSLFLFET

SEQ ID NO: 46788 - protein, 387 aa, Homo sapiens
MGEEGTGGTVHLLCLAASSGVPLFCRSSRGGAPARQQLPFSVIGSLNGVHMFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVMGDGHRHGAVSVSLFIRSQ

SEQ ID NO: 46789 - protein, 382 aa, Homo sapiens
MGEEGTGGTVHLLCLAASSGVPLFCRSSRGGAPARQQLPFSVIGSLNGVHMFGQNLEVQLSSARTENTTVVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 46790 - protein, 92 aa, Homo sapiens
MASLGHILVFCVGLLTMAKAESPKEHDPFTYDYQSLQIGGLVIAGILFILGILIVLSRRCRCKFNQQQRTGEPDEEEGTFRSSIRRLSTRRR

SEQ ID NO: 46791 - protein, 92 aa, Homo sapiens; identical to SEQ ID NO: 46790

SEQ ID NO: 46792 - protein, 64 aa, Homo sapiens
MDRWYLGGSPKGDVDPFYYDYETVRNGGLIFAGLAFIVGLLILLSRRFRCGGNKKRRQINEDEP

SEQ ID NO: 46793 - protein, 66 aa, Homo sapiens
MTGLSMDGGGSPKGDVDPFYYDYETVRNGGLIFAGLAFIVGLLILLSRRFRCGGNKKRRQINEDEP

SEQ ID NO: 46794 - protein, 64 aa, Homo sapiens; identical to SEQ ID NO: 46792

SEQ ID NO: 46795 - protein, 87 aa, Homo sapiens
MQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 46796 - protein, 113 aa, Homo sapiens
MQKVTLGLLVFLAGFPVLDANDLEDKNSPFYYDWHSLQVGGLICAGVLCAMGIIIVMSEWRSSGEQAGRGWGSPPLTTQLSPTGAKCKCKFGQKSGHHPGETPPLITPGSAQS

SEQ ID NO: 46797 - protein, 96 aa, Homo sapiens
MQKVTLGLLVFLAGFPVLDANDLEDKNSPFYYDWHSLQVGGLICAGVLCAMGIIIVMSEWRSSGEQAGRGWGSPPLTTQLSPTGAKCKCKFGQKSG

SEQ ID NO: 46798 - protein, 87 aa, Homo sapiens; identical to SEQ ID NO: 46795

SEQ ID NO: 46799 - protein, 144 aa, Homo sapiens
MGRGYSGALQARGGLEEPLERGLRGPSFTQSPLHGAAAAYLSAQRDASLPVPGQRSDMQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 46800 - protein, 61 aa, Homo sapiens
MQKVTLGLLVFLAGFPVLDANDLEDKNSPFYYGESPCPLSPPHNPTYCLVPRVPIQGWGLT

SEQ ID NO: 46801 - protein, 144 aa, Homo sapiens; identical to SEQ ID NO: 46799

SEQ ID NO: 46802 - protein, 95 aa, Homo sapiens
MELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 46803 - protein, 95 aa, Homo sapiens; identical to SEQ ID NO: 46802

SEQ ID NO: 46804 - protein, 95 aa, Homo sapiens; identical to SEQ ID NO: 46802

SEQ ID NO: 46805 - protein, 95 aa, Homo sapiens; identical to SEQ ID NO: 46802

SEQ ID NO: 46806 - protein, 95 aa, Homo sapiens; identical to SEQ ID NO: 46802

SEQ ID NO: 46807 - protein, 95 aa, Homo sapiens; identical to SEQ ID NO: 46802

SEQ ID NO: 46808 - protein, 80 aa, Homo sapiens
MATPTQTPTKAPEEPDPFYYDYNTVQTVGMTLATILFLLGILIVISKKVKCRKADSRSESPTCKSCKSELPSSAPGGGGV

SEQ ID NO: 46809 - protein, 133 aa, Homo sapiens
MVSVGFGDRAGLGSSCRCSQITPDMASAVATRYVLGHWPRDHICGCGSHQLSSWRAEPDGGVGMPHTLSEPPSGLTGIWAGALVSPEKQMKENLRSNDSEPRLPGFESCLIHSLAVWPWASNFASLGPSVNKG

SEQ ID NO: 46810 - protein, 485 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEEWYFGKLGRKDAERQLLSFGNPRGTFLIRESETTKGAYSLSIRDWDDMKGDHVKHYKIRKLDNGGYYITTRAQFETLQQLVQHYSEKADGLCFNLTVIASSCTPQTSGLAKDAWEVARRSLCLEKKLGQGCFAEVWLGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 46811 - protein, 482 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 46812 - protein, 537 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 46813 - protein, 482 aa, Homo sapiens; identical to SEQ ID NO: 46811

SEQ ID NO: 46814 - protein, 537 aa, Homo sapiens; identical to SEQ ID NO: 46812

SEQ ID NO: 46815 - protein, 534 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSEKADGLCFNLTVIASSCTPQTSGLAKDAWEVARRSLCLEKKLGQGCFAEVWLGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 46816 - protein, 534 aa, Homo sapiens; identical to SEQ ID NO: 46815

SEQ ID NO: 46817 - protein, 120 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWW

SEQ ID NO: 46818 - protein, 232 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYS

SEQ ID NO: 46819 - protein, 106 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKG

SEQ ID NO: 46820 - protein, 65 aa, Homo sapiens
MGCVQCKDKEATKLTEERDGSLNQSSGYRYGTDPTPQHYPSFGVTSIPNYNNFHAAGGQGLTVFG

SEQ ID NO: 46821 - protein, 175 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLI

SEQ ID NO: 46822 - protein, 153 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGK

SEQ ID NO: 46823 - protein, 118 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGD

SEQ ID NO: 46824 - protein, 186 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYS

SEQ ID NO: 46825 - protein, 103 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSF

SEQ ID NO: 46826 - protein, 152 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFG

SEQ ID NO: 46827 - protein, 116 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSE

SEQ ID NO: 46828 - protein, 140 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAP

SEQ ID NO: 46829 - protein, 145 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQ

SEQ ID NO: 46830 - protein, 534 aa, Homo sapiens; identical to SEQ ID NO: 46815

SEQ ID NO: 46831 - protein, 485 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEAQAEEWYFGKLGRKDAERQLLSFGNPRGTFLIRESETTKGAYSLSIRDWDDMKGDHVKHYKIRKLDNGGYYITTRAQFETLQQLVQHYSEKADGLCFNLTVIASSCTPQTSGLAKDAWEVARRSLCLEKKLGQGCFAEVWLGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 46832 - protein, 1478 aa, Homo sapiens
MASTNAESQLQRIIRDLQDAVTELSKEFQEAGEPITDDSTSLHKFSYKLEYLLQFDQKEKATLLGNKKDYWDYFCACLAKVKGANDGIRFVKSISELRTSLGKGRAFIRYSLVHQRLADTLQQCFMNTKVTSDWYYARSPFLQPKLSSDIVGQLYELTEVQFDLASRGFDLDAAWPTFARRTLTTGSSAYLWKPPSRSSSMSSLVSSYLQTQEMVSNFDLNSPLNNEALEGFDEMRLELDQLEVREKQLRERMQQLDRENQELRAAVSQQGEQLQTERERGRTAAEDNVRLTCLVAELQKQWEVTQATQNTVKELQTCLQGLELGAAEKEEDYHTALRRLESMLQPLAQELEATRDSLDKKNQHLASFPGWLAMAQQKADTASDTKGRQEPIPSDAAQEMQELGEKLQALERERTKVEEVNRQQSAQLEQLVKELQLKEDARASLERLVKEMAPLQEELSGKGQEADQLWRRLQELLAHTSSWEEELAELRREKKQQQEEKELLEQEVRSLTRQLQFLETQLAQVSQHVSDLEEQKKQLIQDKDHLSQQVGMLERLAGPPGPELPVAGEKNEALVPVNSSLQEAWGKPEEEQRGLQEAQLDDTKVQEGSQEEELRQANRELEKELQNVVGRNQLLEGKLQALQADYQALQQRESAIQGSLASLEAEQASIRHLGDQMEASLLAVRKAKEAMKAQMAEKEAILQSKEGECQQLREEVEQCQQLAEARHRELRALESQCQQQTQLIEVLTAEKGQQGVGPPTDNEARELAAQLALSQAQLEVHQGEVQRLQAQVVDLQAKMRAALDDQDKVQSQLSMAEAVLREHKTLVQQLKEQNEALNRAHVQELLQCSEREGALQEERADEAQQREEELRALQEELSQAKCSSEEAQLEHAELQEQLHRANTDTAELGIQVCALTVEKERVEEALACAVQELQDAKEAASREREGLERQVAGLQQEKESLQEKLKAAKAAAGSLPGLQAQLAQAEQRAQSLQEAAHQELNTLKFQLSAEIMDYQSRLKNAGEECKSLRGQLEEQGRQLQAAEEAVEKLKATQADMGEKLSCTSNHLAECQAAMLRKDKEGAALREDLERTQKELEKATTKIQEYYNKLCQEVTNRERNDQKMLADLDDLNRTKKYLEERLIELLRDKDALWQKSDALEFQQKLSAEERWLGDTEANHCLDCKREFSWMVRRHHCRICGRIFCYYCCNNYVLSKHGGKKERCCRACFQKLSEGPGSPDSSGSGTSQGEPSPALSPASPGPQATGGQGANTDYRPPDDAVFDIITDEELCQIQESGSSLPETPTETDSLDPNAAEQDTTSTSLTPEDTEDMPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 46833 - protein, 267 aa, Homo sapiens
  MOD_RES (1)..(1): Any amino acid
XSKHGGKKERCCRACFQKLSEGPGSPDSSGSGTSQGEPSPALSPASPGPQATGGQGANTDYRPPDDAVFDIITDEELCQIQESGSSLPETPTETDSLDPNAAEQDTTSTSLTPEDTEDMPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 46834 - protein, 1498 aa, Homo sapiens
MASTNAESQLQRIIRDLQDAVTELSKEFQEAGEPITDDSTSLHKFSYKLEYLLQFDQKEKATLLGNKKDYWDYFCACLAKVKGANDGIRFVKSISELRTSLGKGRAFIRYSLVHQRLADTLQQCFMNTKVTSDWYYARSPFLQPKLSSDIVGQLYELTEVQFDLASRGFDLDAAWPTFARRTLTTGSSAYLWKPPSRSSSMSSLVSSYLQTQEMVSNFDLNSPLNNEALEGFDEMRLELDQLEVREKQLRERMQQLDRENQELRAAVSQQGEQLQTERERGRTAAEDNVRLTCLVAELQKQWEVTQATQNTVKELQTCLQGLELGAAEKEEDYHTALRRLESMLQPLAQELEATRDSLDKKNQHLASFPGWLAMAQQKADTASDTKGRQEPIPSDAAQEMQELGEKLQALERERTKVEEVNRQQSAQLEQLVKELQLKEDARASLERLVKEMAPLQEELSGKGQEADQLWRRLQELLAHTSSWEEELAELRREKKQQQEEKELLEQEVRSLTRQLQFLETQLAQVSQHVSDLEEQKKQLIQDKDHLSQQVGMLERLAGPPGPELPVAGEKNEALVPVNSSLQEAWGKPEEEQRGLQEAQLDDTKVQEGSQEEELRQANRELEKELQNVVGRNQLLEGKLQALQADYQALQQRESAIQGSLASLEAEQASIRHLGDQMEASLLAVRKAKEAMKAQMAEKEAILQSKEGECQQLREEVEQCQQLAEARHRELRALESQCQQQTQLIEVLTAEKGQQGVGPPTDNEARELAAQLALSQAQLEVHQGEVQRLQAQVVDLQAKMRAALDDQDKVQSQLSMAEAVLREHKTLVQQLKEQNEALNRAHVQELLQCSEREGALQEERADEAQQREEELRALQEELSQAKCSSEEAQLEHAELQEQLHRANTDTAELGIQVCALTVEKERVEEALACAVQELQDAKEAASREREGLERQVAGLQQEKESLQEKLKAAKAAAGSLPGLQAQLAQAEQRAQSLQEAAHQELNTLKFQLSAEIMDYQSRLKNAGEECKSLRGQLEEQGRQLQAAEEAVEKLKATQADMGEKLSCTSNHLAECQAAMLRKDKEGAALREDLERTQKELEKATTKIQEYYNKLCQEVTNRERNDQKMLADLDDLNRTKKYLEERLIELLRDKDALWQKSDALEFQQKLSAEERWLGDTEANHCLDCKREFSWMVRRHHCRICGRIFCYYCCNNYVLSKHGGKKERCCRACFQKLSEGPGSPDSSGSGTSQGEPSPALSPASPGPQATGGQGANTDYRPPDDAVFDIITDEELCQIQESGSSLPETPTETDSLDPNAAEQASVGASKGLGNLLCESSACRDTTSTSLTPEDTEDMPVGQDSEICLLKSGELMIKVPLTVDEIASFGEGSRELFVRSSTYSLIPITVAEAGLTISWVFSSDPKSISFSVVFQEAEDTPLDQCKVLIPTTRCNSHKENIQGQLKVRTPGIYMLIFDNTFSRFVSKKVFYHLTVDRPVIYDGSDFL

SEQ ID NO: 46835 - protein, 961 aa, Homo sapiens
MHGHRAPGGAGPSEPEHPATNPPGAAPPACADSDPGASEPGLLARRGSGSALGGPLDPQFVGPSDTSLGAAPGHRVLPCGPSPQHHRALRFSYHLEGSQPRPGLHQGNRILVKSLSLDPGQSLEPHPEGPQRLRSDPGPPTETPSQRPSPLKRAPGPKPQVPPKPSYLQMPRMPPPLEPIPPPPSRPLPADPRVAKGLAPRAEASPSSAAVSSLIEKFEREPVIVASDRPVPGPSPGPPEPVMLPQPTSQPPVPQLPEGEASRCLFLLAPGPRDGEKVPNRDSGIDSISSPSNSEETCFVSDDGPPSHSLCPGPPALASVPVALADPHRPGSQEVDSDLEEEDDEEEEEEKDREIPVPLMERQESVELTVQQKVFHIANELLQTEKAYVSRLHLLDQVFCARLLEEARNRSSFPADVVHGIFSNICSIYCFHQQFLLPELEKRMEEWDRYPRIGDILQKLAPFLKMYGEYVKNFDRAVELVNTWTERSTQFKVIIHEVQKEEACGNLTLQHHMLEPVQRIPRYELLLKDYLLKLPHGSPDSKDAQKSLELIATAAEHSNAAIRKMERMHKLLKVYELLGGEEDIVSPTKELIKEGHILKLSAKNGTTQDRYLILFNDRLLYCVPRLRLLGQKFSVRARIDVDGMELKESSNLNLPRTFLVSGKQRSLELQARTEEEKKDWVQAINSTLLKHEQTLETFKLLNSTNREDEDTPPNSPNVDLGKRAPTPIREKEVTMCMRCQEPFNSITKRRHHCKACGHVVCGKCSEFRARLVYDNNRSNRVCTDCYVALHGVPGSSPACSQHTPQRRRSILEKQASVAAENSVICSFLHYMEKGGKGWHKAWFVVPENEPLVLYIYGAPQDVKAQRSLPLIGFEVGPPEAGERPDRRHVFKITQSHLSWYFSPETEELQRRWMAVLGRAGRGDTFCPGPTLSEDREMEEAPVAALGATAEPPESPQTRDKT

SEQ ID NO: 46836 - protein, 655 aa, Homo sapiens
MKGASEEKLASVSNLVTVFENSRTPEAAPRGQRLEDVHHRPECRPPESPGPREKTNVGEAVGSEPRTVSRRYLNSLKNKLSSEAWRKSCQPVTLSGSGTQEPEKKIVQELLETEQAYVARLHLLDQVFFQELLKTARSSKAFPEDVVRVIFSNISSIYQFHSQFFLPELQRRLDDWTANPRIGDVIQKLAPFLKMYSEYVKNFERAAELLATWTDKSPLFQEVLTRIQSSEASGSLTLQHHMLEPVQRIPRYELLLKEYIQKLPAQAPDQADAQKALDMIFSAAQHSNAAITEMERLQDLWEVYQRLGLEDDIVDPSNTLLREGPVLKISFRRNDPMERYLFLFNNMLLYCVPRVIQVGAQFQVRTRIDVAGMKVRELMDAEFPHSFLVSGKQRTLELQARSQEEMISWMQAFQAAIDQIEKRNETFKAAAQGPEGDIQEQELQSEELGLRAPQWVRDKMVTMCMRCQEPFNALTRRRHHCRACGYVVCARCSDYRAELKYDDNRPNRVCLHCYAFLTGNVLPEAKEDKRRGILEKGSSATPDQSLMCSFLQLIGDKWGKSGPRGWCVIPRDDPLVLYVYAAPQDMRAHTSIPLLGYQVTVGPQGDPRVFQLQQSGQLYTFKAETEELKGRWVKAMERAASGWSPSWPNDGDLSD

SEQ ID NO: 46837 - protein, 283 aa, Homo sapiens
MKVRELMDAEFPHSFLVSGKQRTLELQARSQEEMISWMQAFQAAIDQIEKRNETFKAAAQGPEGDIQEQELQSEELGLRAPQWVRDKMVTMCMRCQEPFNALTRRRHHCRACGYVVCARCSDYRAELKYDDNRPNRVCLHCYAFLTGNVLPEAKEDKRRGILEKGSSATPDQSLMCSFLQLIGDKWGKSGPRGWCVIPRDDPLVLYVYAAPQDMRAHTSIPLLGYQVTVGPQGDPRVFQLQQSGQLYTFKAETEELKGRWVKAMERAASGWSPSWPNDGDLSD

SEQ ID NO: 46838 - protein, 725 aa, Homo sapiens
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 46839 - protein, 725 aa, Homo sapiens; identical to SEQ ID NO: 46838

SEQ ID NO: 46840 - protein, 724 aa, Homo sapiens
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTETPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 46841 - protein, 328 aa, Homo sapiens
MILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 46842 - protein, 471 aa, Homo sapiens
MVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQVSKPHLSEGTDALGGKGKRVDSGLKICRTRVQAVSLFH

SEQ ID NO: 46843 - protein, 280 aa, Homo sapiens
MVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKRRGFAMLPRLISNS

SEQ ID NO: 46844 - protein, 188 aa, Homo sapiens
MFSCFLCILSFSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKVEHETSS

SEQ ID NO: 46845 - protein, 766 aa, Homo sapiens
MEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 46846 - protein, 207 aa, Homo sapiens
MEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKVEHETSS

SEQ ID NO: 46847 - protein, 878 aa, Homo sapiens
MNFKRVKPNIFLLNQSRLIISICEIMSTDQGSSTCPKIALVPPCSTSSTTTLVGENVSEEEAQGINGNRPAKHSAASPKPQVPPKPLHLQNSPSSNIHQTPRHKALPSAKPRMEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 46848 - protein, 851 aa, Homo sapiens
MGGCSSTCPKIALVPPCSTSSTTTLVGENVSEEEAQGINGNRPAKHSAASPKPQVPPKPLHLQNSPSSNIHQTPRHKALPSAKPRMEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 46849 - protein, 903 aa, Homo sapiens
MSDEGGSNFRRVAIRRKSNPSYLPPGVPRPWSRPASHLGRVGTAAFKGQVPSGATGSSTCPKIALVPPCSTSSTTTLVGENVSEEEAQGINGNRPAKHSAASPKPQVPPKPLHLQNSPSSNIHQTPRHKALPSAKPRMEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 46850 - protein, 139 aa, Homo sapiens
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEEMRSHYVAQTGILWLLMNNCFLNLSPRKP

SEQ ID NO: 46851 - protein, 116 aa, Homo sapiens [sequence omitted]

SEQ ID NO: 46852 - protein, 117 aa, Homo sapiens
MSWRGRSTYYWPRPRRYVQPPEMIGPMRPEQFSDEVEPATPEEGEPATQCQDPAAAQEGEDEGASAGQGPKPEAHSQEQGHPQTGCECEDGPDGQEMDPPNPEEVKTPEEGEKQSQC

SEQ ID NO: 46853 - protein, 117 aa, Homo sapiens; identical to SEQ ID NO: 46852

SEQ ID NO: 46854 - protein, 117 aa, Homo sapiens; identical to SEQ ID NO: 46852

SEQ ID NO: 46855 - protein, 117 aa, Homo sapiens
MSWRGRSTYYWPRPRRYVQPPEMIGPMRPEQFSDEVEPATPEEGEPATQRQDPAAAQEGEDEGASAGQGPKPEAHSQEQGHPQTGCECEDGPDGQEMDPPNPEEVKTPEEGEKQSQC

SEQ ID NO: 46856 - protein, 117 aa, Homo sapiens; identical to SEQ ID NO: 46855

SEQ ID NO: 46857 - protein, 117 aa, Homo sapiens
MSWRGRSTYYWPRPRRYVQPPEMIGPMRPEQFSDEVEPATPEEGEPATQCQDPAAAQKGEDEGASAGQGPKPEAHSQEQGHPQTGCECEDGPDGQEMDPPNPEEVKTPEEGEKQSQC

SEQ ID NO: 46858 - protein, 117 aa, Homo sapiens
MSWRGRSTYYWPRPRPYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGKKQSQC

SEQ ID NO: 46859 - protein, 117 aa, Homo sapiens
MSWRGRSTYYRPRPRRYVEPPEMIGPMRPEQFSDEVEPATPEEGEPATQCQDPAAAQEGEDEGASAGQGPKPEADSQEQGHPQTGCECEDGPDGQEMDPPNPEEVKTPEEGKKQSQC

SEQ ID NO: 46860 - protein, 116 aa, Homo sapiens
MSWRGRSTYRPRPRRYVEPPEMIGPMRPEQFSDEVEPATPEEGEPATQRQDPAAAQEGQDEGASAGQGPKPEAHSQEQGHPQTGCECEDGPDGQEMDPPNPEEVKTPEEGEKQSQC

SEQ ID NO: 46861 - protein, 116 aa, Homo sapiens
MSWRGRSTYRPRPRRYVEPPEMIGPMRPEQFSDEVEPATPEEGEPATQRQDPAAAQEGEDEGASAGQGPKPEAHSQEQGHPQTGCECEDGPDGQEMDPPNPEEVKTPEEGEKQSQC

SEQ ID NO: 46862 - protein, 116 aa, Homo sapiens; identical to SEQ ID NO: 46861

SEQ ID NO: 46863 - protein, 116 aa, Homo sapiens
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 46864 - protein, 116 aa, Homo sapiens
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEGKKQSQC

SEQ ID NO: 46865 - protein, 144 aa, Homo sapiens
MFLEEKIPSISDLKLAIRRATLKRSFTPVFLGSALKNKGVQPLLDAVLEYLPNPSEVQNYAILNKEDDSKEKTKILMNSSRDNSHPFVGLAFKLEFLSRSFFRLTRQKDHRRPIQRTTLYLIVMSPYDLLGCNSFLDFPCFSRD

SEQ ID NO: 46866 - protein, 751 aa, Homo sapiens
MRLLGAAAVAALGRGRAPASLGWQRKQVNWKACRWSSSGVIPNEKIRNIGISAHIDSGKTTLTERVLYYTGRIAKMHEVKGKDGVGAVMDSMELERQRGITIQSAATYTMWKDVNINIIDTPGHVDFTIEVERALRVLDGAVLVLCAVGGVQCQTMTVNRQMKRYNVPFLTFINKLDRMGSNPARALQQMRSKLNHNAAFMQIPMGLEGNFKGIVDLIEERAIYFDGDFGQIVRYGEIPAELRAAATDHRQELIECVANSDEQLGEMFLEEKIPSISDLKLAIRRATLKRSFTPVFLGSALKNKGVQPLLDAVLEYLPNPSEVQNYAILNKEDDSKEKTKILMNSSRDNSHPFVGLAFKLEVGRFGQLTYVRSYQGELKKGDTIYNTRTRKKVRLQRLARMHADMMEDVEEVYAGDICALFGIDCASGDTFTDKANSGLSMESIHVPDPVISIAMKPSNKNDLEKFSKGIGRFTREDPTFKVYFDTENKETVISGMGELHLEIYAQRLEREYGCPCITGKPKVAFRETITAPVPFDFTHKKQSGGAGQYGKVIGVLEPLDPEDYTKLEFSDETFGSNIPKQFVPAVEKGFLDACEKGPLSGHKLSGLRFVLQDGAHHMVDSNEISFIRAGEGALKQALANATLCILEPIMAVEVVAPNEFQGQVIAGINRRHGVITGQDGVEDYFTLYADVPLNDMFGYSTELRSCTEGKGEYTMEYSRYQPCLPSTQEDVINKYLEATGQLPVKKGKAKN

SEQ ID NO: 46867 - protein, 356 aa, Homo sapiens
MSRPLLITFTPATDPSDLWKDGQQQPQPEKPESTLDGAAALAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISSPGFKLLLRGGWEPGMGLGPRGEGRANPIPTVLKRDQEGLGYRSAPQPRVTHFPAWDTRAVAGRERPPRVATLSWREERRREEKDRAWERDLRTYMNLEF

SEQ ID NO: 46868 - protein, 356 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISSPGFKLLLRGGWEPGMGLGPRGEGRANPIPTVLKRDQEGLGYRSAPQPRVTHFPAWDTRAVAGRERPPRVATLSWREERRREEKDRAWERDLRTYMNLEF

SEQ ID NO: 46869 - protein, 356 aa, Homo sapiens; identical to SEQ ID NO: 46868

SEQ ID NO: 46870 - protein, 356 aa, Homo sapiens; identical to SEQ ID NO: 46868

SEQ ID NO: 46871 - protein, 356 aa, Homo sapiens; identical to SEQ ID NO: 46868

SEQ ID NO: 46872 - protein, 356 aa, Homo sapiens; identical to SEQ ID NO: 46868

SEQ ID NO: 46873 - protein, 356 aa, Homo sapiens; identical to SEQ ID NO: 46867

SEQ ID NO: 46874 - protein, 356 aa, Homo sapiens; identical to SEQ ID NO: 46867

SEQ ID NO: 46875 - protein, 356 aa, Homo sapiens; identical to SEQ ID NO: 46867

SEQ ID NO: 46876 - protein, 356 aa, Homo sapiens; identical to SEQ ID NO: 46867

SEQ ID NO: 46877 - protein, 356 aa, Homo sapiens; identical to SEQ ID NO: 46867

SEQ ID NO: 46878 - protein, 165 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGR

SEQ ID NO: 46879 - protein, 152 aa, Homo sapiens
MSRPLLITFTPATDPSDLWKDGQQQPQPEKPESTLDGAAALAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAAR

SEQ ID NO: 46880 - protein, 356 aa, Homo sapiens; identical to SEQ ID NO: 46867

SEQ ID NO: 46881 - protein, 152 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAAR

SEQ ID NO: 46882 - protein, 165 aa, Homo sapiens
MSRPLLITFTPATDPSDLWKDGQQQPQPEKPESTLDGAAALAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGR

SEQ ID NO: 46883 - protein, 90 aa, Homo sapiens
MSRPLLITFTPATDPSDLWKDGQQQPQPEKPESTLDGAAALAFYEALIGDESSAPDSQRSQTEPARERKRKKRRIMKAPAAEAVAEGASG

SEQ ID NO: 46884 - protein, 356 aa, Homo sapiens; identical to SEQ ID NO: 46868

SEQ ID NO: 46885 - protein, 356 aa, Homo sapiens; identical to SEQ ID NO: 46868

SEQ ID NO: 46886 - protein, 107 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHR

SEQ ID NO: 46887 - protein, 107 aa, Homo sapiens
MSRPLLITFTPATDPSDLWKDGQQQPQPEKPESTLDGAAALAFYEALIGDESSAPDSQRSQTEPARERKRKKRRIMKAPAAEAVAEGASGRHGQGRSLEAEDKMTHR

SEQ ID NO: 46888 - protein, 356 aa, Homo sapiens; identical to SEQ ID NO: 46868

SEQ ID NO: 46889 - protein, 356 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISSPGFKLLLRRGWEPGMGLGPRGEGRANPIPTVLKRDQEGLGYRSAPQPRVTHFPAWDTRAVAGRERPPRVATLSWREERRREEKDRAWERDLRTYMNLEF

SEQ ID NO: 46890 - protein, 356 aa, Homo sapiens; identical to SEQ ID NO: 46889

SEQ ID NO: 46891 - protein, 165 aa, Homo sapiens; identical to SEQ ID NO: 46878

SEQ ID NO: 46892 - protein, 356 aa, Homo sapiens; identical to SEQ ID NO: 46868

SEQ ID NO: 46893 - protein, 198 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRE

SEQ ID NO: 46894 - protein, 356 aa, Homo sapiens; identical to SEQ ID NO: 46889

SEQ ID NO: 46895 - protein, 165 aa, Homo sapiens; identical to SEQ ID NO: 46882

SEQ ID NO: 46896 - protein, 152 aa, Homo sapiens; identical to SEQ ID NO: 46879

SEQ ID NO: 46897 - protein, 152 aa, Homo sapiens; identical to SEQ ID NO: 46879

SEQ ID NO: 46898 - protein, 198 aa, Homo sapiens
MSRPLLITFTPATDPSDLWKDGQQQPQPEKPESTLDGAAALAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRE

SEQ ID NO: 46899 - protein, 198 aa, Homo sapiens; identical to SEQ ID NO: 46898

SEQ ID NO: 46900 - protein, 356 aa, Homo sapiens; identical to SEQ ID NO: 46889

SEQ ID NO: 46901 - protein, 356 aa, Homo sapiens; identical to SEQ ID NO: 46867

SEQ ID NO: 46902 - protein, 198 aa, Homo sapiens; identical to SEQ ID NO: 46898

SEQ ID NO: 46903 - protein, 356 aa, Homo sapiens; identical to SEQ ID NO: 46867

SEQ ID NO: 46904 - protein, 198 aa, Homo sapiens; identical to SEQ ID NO: 46893

SEQ ID NO: 46905 - protein, 356 aa, Homo sapiens; identical to SEQ ID NO: 46868

SEQ ID NO: 46906 - protein, 107 aa, Homo sapiens; identical to SEQ ID NO: 46886

SEQ ID NO: 46907 - protein, 356 aa, Homo sapiens; identical to SEQ ID NO: 46889

SEQ ID NO: 46908 - protein, 107 aa, Homo sapiens; identical to SEQ ID NO: 46886

SEQ ID NO: 46909 - protein, 152 aa, Homo sapiens; identical to SEQ ID NO: 46881

SEQ ID NO: 46910 - protein, 356 aa, Homo sapiens; identical to SEQ ID NO: 46867

SEQ ID NO: 46911 - protein, 356 aa, Homo sapiens; identical to SEQ ID NO: 46867

SEQ ID NO: 46912 - protein, 165 aa, Homo sapiens; identical to SEQ ID NO: 46878

SEQ ID NO: 46913 - protein, 90 aa, Homo sapiens; identical to SEQ ID NO: 46883

SEQ ID NO: 46914 - protein, 356 aa, Homo sapiens; identical to SEQ ID NO: 46868

SEQ ID NO: 46915 - protein, 90 aa, Homo sapiens; identical to SEQ ID NO: 46883

SEQ ID NO: 46916 - protein, 356 aa, Homo sapiens; identical to SEQ ID NO: 46868

SEQ ID NO: 46917 - protein, 198 aa, Homo sapiens; identical to SEQ ID NO: 46893

SEQ ID NO: 46918 - protein, 107 aa, Homo sapiens; identical to SEQ ID NO: 46887

SEQ ID NO: 46919 - protein, 107 aa, Homo sapiens; identical to SEQ ID NO: 46887

SEQ ID NO: 46920 - protein, 90 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASG

SEQ ID NO: 46921 - protein, 90 aa, Homo sapiens; identical to SEQ ID NO: 46920

SEQ ID NO: 46922 - protein, 152 aa, Homo sapiens; identical to SEQ ID NO: 46881

SEQ ID NO: 46923 - protein, 198 aa, Homo sapiens; identical to SEQ ID NO: 46893

SEQ ID NO: 46924 - protein, 356 aa, Homo sapiens; identical to SEQ ID NO: 46867

SEQ ID NO: 46925 - protein, 356 aa, Homo sapiens; identical to SEQ ID NO: 46868

SEQ ID NO: 46926 - protein, 356 aa, Homo sapiens; identical to SEQ ID NO: 46868

SEQ ID NO: 46927 - protein, 165 aa, Homo sapiens; identical to SEQ ID NO: 46882

SEQ ID NO: 46928 - protein, 90 aa, Homo sapiens; identical to SEQ ID NO: 46920

SEQ ID NO: 46929 - protein, 107 aa, Homo sapiens; identical to SEQ ID NO: 46886

SEQ ID NO: 46930 - protein, 356 aa, Homo sapiens; identical to SEQ ID NO: 46868

SEQ ID NO: 46931 - protein, 356 aa, Homo sapiens; identical to SEQ ID NO: 46867

SEQ ID NO: 46932 - protein, 356 aa, Homo sapiens; identical to SEQ ID NO: 46867

SEQ ID NO: 46933 - protein, 90 aa, Homo sapiens; identical to SEQ ID NO: 46920

SEQ ID NO: 46934 - protein, 356 aa, Homo sapiens; identical to SEQ ID NO: 46867

SEQ ID NO: 46935 - protein, 165 aa, Homo sapiens; identical to SEQ ID NO: 46878

SEQ ID NO: 46936 - protein, 152 aa, Homo sapiens; identical to SEQ ID NO: 46881

SEQ ID NO: 46937 - protein, 1502 aa, Homo sapiens
MADRFSRFNEDRDFQGNHFDQYEEGHLEIEQASLDKPIESDNIGHRLLQKHGWKLGQGLGKSLQGRTDPIPIVVKYDVMGMGRMEMELDYAEDATERRRVLEVEKEDTEELRQKYKDYVDKEKAIAKALEDLRANFYCELCDKQYQKHQEFDNHINSYDHAHKQRLKDLKQREFARNVSSRSRKDEKKQEKALRRLHELAEQRKQAECAPGSGPMFKPTTVAVDEEGGEDDKDESATNSGTGATASCGLGSEFSTDKGGPFTAVQITNTTGLAQAPGLASQGISFGIKNNLGTPLQKLGVSFSFAKKAPVKLESIASVFKDHAEEGTSEDGTKPDEKSSDQGLQKVGDSDGSSNLDGKKEDEDPQDGGSLASTLSKLKRMKREEGAGATEPEYYHYIPPAHCKVKPNFPFLLFMRASEQMDGDNTTHPKNAPESKKGSSPKPKSCIKAAASQGAEKTVSEVSEQPKETSMTEPSEPGSKAEAKKALGGDVSDQSLESHSQKVSETQMCESNSSKETSLATPAGKESQEGPKHPTGPFFPVLSKDESTALQWPSELLIFTKAEPSISYSCNPLYFDFKLSRNKDARTKGTEKPKDIGSSSKDHLQGLDPGEPNKSKEVGGEKIVRSSGGRMDAPASGSACSGLNKQEPGGSHGSETEDTGRSLPSKKERSGKSHRHKKKKKHKKSSKHKRKHKADTEEKSSKAESGEKSKKRKKRKRKKNKSSAPADSERGPKPEPPGSGSPAPPRRRRRAQDDSQRRSLPAEEGSSGKKDEGGGGSSSQDHGGRKHKGELPPSSCQRRAGTKRSSRSSHRSQPSSGDEDSDDASSHRLHQKSPSQYSEEEEEEDSGSEHSRSRSRSGRRHSSHRSSRRSYSSSSDASSDQSCYSRQRSYSDDSYSDYSDRSRRHSKRSHDSDDSDYASSKHRSKRHKYSSSDDDYSLSCSQSRSRSRSHTRERSRSRGRSRSSSCSRSRSKRRSRSTTAHSWQRSRSYSRDRSRSTRSPSQRSGSRKRSWGHESPEERHSGRRDFIRSKIYRSQSPHYFRSGRGEGPGKKDDGRGDDSKATGPPSQNSNIGTGRGSEGDCSPEDKNSVTAKLLLEKIQSRKVERKPSVSEEVQATPNKAGPKLKDPPQGYFGPKLPPSLGNKPVLPLIGKLPATRKPNKKCEESGLERGEEQEQSETEEGPPGSSDALFGHQFPSEETTGPLLDPPPEESKSGEATADHPVAPLGTPAHSDCYPGDPTISHNYLPDPSDGDTLESLDSSSQPGPVESSLLPIAPDLEHFPSYAPPSGDPSIESTDGAEDASLAPLESQPITFTPEEMEKYSKLQQAAQQHIQQQLLAKQVKAFPASAALAPATPALQPIHIQQPATASATSITTVQHAILQHHAAAAAAAIGIHPHPHPQPLAQVHHIPQPHLTPISLSHLTHSIIPGHPATFLASHPIHIIPASAIHPGPFTFHPVPHAALYPTLLAPRPAAAAATALHLHPLLHPIFSGQDLQHPPSHGT

SEQ ID NO: 46938 - protein, 1424 aa, Homo sapiens
MGMGRMEMELDYAEDATERRRVLEVEKEDTEELRQKYKDYVDKEKAIAKALEDLRANFYCELCDKQYQKHQEFDNHINSYDHAHKQRLKDLKQREFARNVSSRSRKDEKKQEKALRRLHELAEQRKQAECAPGSGPMFKPTTVAVDEEGGEDDKDESATNSGTGATASCGLGSEFSTDKGGPFTAVQITNTTGLAQAPGLASQGISFGIKNNLGTPLQKLGVSFSFAKKAPVKLESIASVFKDHAEEGTSEDGTKPDEKSSDQGLQKVGDSDGSSNLDGKKEDEDPQDGGSLASTLSKLKRMKREEGAGATEPEYYHYIPPAHCKVKPNFPFLLFMRASEQMDGDNTTHPKNAPESKKGSSPKPKSCIKAAASQGAEKTVSEVSEQPKETSMTEPSEPGSKAEAKKALGGDVSDQSLESHSQKVSETQMCESNSSKETSLATPAGKESQEGPKHPTGPFFPVLSKDESTALQWPSELLIFTKAEPSISYSCNPLYFDFKLSRNKDARTKGTEKPKDIGSSSKDHLQGLDPGEPNKSKEVGGEKIVRSSGGRMDAPASGSACSGLNKQEPGGSHGSETEDTGRSLPSKKERSGKSHRHKKKKKHKKSSKHKRKHKADTEEKSSKAESGEKSKKRKKRKRKKNKSSAPADSERGPKPEPPGSGSPAPPRRRRRAQDDSQRRSLPAEEGSSGKKDEGGGGSSSQDHGGRKHKGELPPSSCQRRAGTKRSSRSSHRSQPSSGDEDSDDASSHRLHQKSPSQYSEEEEEEDSGSEHSRSRSRSGRRHSSHRSSRRSYSSSSDASSDQSCYSRQRSYSDDSYSDYSDRSRRHSKRSHDSDDSDYASSKHRSKRHKYSSSDDDYSLSCSQSRSRSRSHTRERSRSRGRSRSSSCSRSRSKRRSRSTTAHSWQRSRSYSRDRSRSTRSPSQRSGSRKRSWGHESPEERHSGRRDFIRSKIYRSQSPHYFRSGRGEGPGKKDDGRGDDSKATGPPSQNSNIGTGRGSEGDCSPEDKNSVTAKLLLEKIQSRKVERKPSVSEEVQATPNKAGPKLKDPPQGYFGPKLPPSLGNKPVLPLIGKLPATRKPNKKCEESGLERGEEQEQSETEEGPPGSSDALFGHQFPSEETTGPLLDPPPEESKSGEATADHPVAPLGTPAHSDCYPGDPTISHNYLPDPSDGDTLESLDSSSQPGPVESSLLPIAPDLEHFPSYAPPSGDPSIESTDGAEDASLAPLESQPITFTPEEMEKYSKLQQAAQQHIQQQLLAKQVKAFPASAALAPATPALQPIHIQQPATASATSITTVQHAILQHHAAAAAAAIGIHPHPHPQPLAQVHHIPQPHLTPISLSHLTHSIIPGHPATFLASHPIHIIPASAIHPGPFTFHPVPHAALYPTLLAPRPAAAAATALHLHPLLHPIFSGQDLQHPPSHGT

SEQ ID NO: 46939 - protein, 43 aa, Homo sapiens
MADRFSRFNEDRDFQGNHFDQYEEGHLEIEQASLDKPIESSCF

SEQ ID NO: 46940 - protein, 1502 aa, Homo sapiens; identical to SEQ ID NO: 46937

SEQ ID NO: 46941 - protein, 491 aa, Homo sapiens
MPLPVQVFNLQGAVEPMQIDVDPQEDPQNAPDVNYVVENPSLDLEQYAASYSGLMRIERLQFIADHCPTLRVEALKMALSFVQRTFNVDMYEEIHRKLSEATRSSLRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 46942 - protein, 550 aa, Homo sapiens
MPLPVQVFNLQQPASSVSGSGGAESQDRMRDSSAPSSASSSVTDLYCTPHSSRSDLVLPGTAGDFSLSASLSACTLLYEGAVEPMQIDVDPQEDPQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKPLPTSTDLGPPGGSVLPAAQLRGLATGCHPACVPSLGLRRQAAASCGPSWKERPAGLDPVGFCPQGADCAAPRPSGTISQTPPVPASVRCRQVGGVH

SEQ ID NO: 46943 - protein, 527 aa, Homo sapiens
MRDSSAPSSASSSVTDLYCTPHSSRSDLVLPGTAGDFSLSASLSACTLLYEGAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 46944 - protein, 284 aa, Homo sapiens
GQPEIGGFLPSSLAPVTAAILMARSSLRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEVRATSSETLPPGFLTTAGPSCPPPPHSPPDLNLPSSPLSLGAGHRALGNVEHGPHACGFLLQQRGERDSQTQAILTKLKCAAGEGLGHAQLTPRSPVAKSSQPRAVGWSLPQPGKTSLAGRRMLWAHVQV

SEQ ID NO: 46945 - protein, 527 aa, Homo sapiens; identical to SEQ ID NO: 46943

SEQ ID NO: 46946 - protein, 330 aa, Homo sapiens
MTPNSTGEVPSPIPKGALGLSLALASLIITANLLLALGIAWDRRLRSPPAGCFFLSLLLAGLLTGLALPTLPGLWNQSRRGYWSCLLVYLAPNFSFLSLLANLLLVHGERYMAVLRPLQPPGSIRLALLLTWAGPLLFASLPALGWNHWTPGANCSSQAIFPAPYLYLEVYGLLLPAVGAAAFLSVRVLATAHRQLQDICRLERAVCRDEPSALARALTWRQARAQAGAMLLFGLCWGPYVATLLLSVLAYEQRPPLGPGTLLSLLSLGSASAAAVPVAMGLGDQRYTAPWRAAAQRCLQGLWGRASRDSPGPSIAYHPSSQSSVDLDLN

SEQ ID NO: 46947 - protein, 330 aa, Homo sapiens; identical to SEQ ID NO: 46946

SEQ ID NO: 46948 - protein, 330 aa, Homo sapiens; identical to SEQ ID NO: 46946

SEQ ID NO: 46949 - protein, 330 aa, Homo sapiens; identical to SEQ ID NO: 46946

SEQ ID NO: 46950 - protein, 375 aa, Homo sapiens
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTGHIVNLAAFSNSCLNPLIYSFLGETFRDKLRLYIEQKTNLPALNRFCHAALKAVIPDSTEQSDVRFSSAV

SEQ ID NO: 46951 - protein, 176 aa, Homo sapiens
MSLNCGQMWLLAPRGLARVTLAWSPWGCLGNLTTGHLALLTQNCYNPKALAPQGPKASGDQPVTQLLPANPACRCTCLPLQETFLSVLHLPGWQQWRCAASPGPRGAAALGPEQQEGPSVERPPSAPGWFSHCLLTSTWQLHSCGLGPCELPCGLVGCQDNEILQHLWLTNLFLQK

SEQ ID NO: 46952 - protein, 375 aa, Homo sapiens; identical to SEQ ID NO: 46950

SEQ ID NO: 46953 - protein, 375 aa, Homo sapiens; identical to SEQ ID NO: 46950

SEQ ID NO: 46954 - protein, 375 aa, Homo sapiens; identical to SEQ ID NO: 46950

SEQ ID NO: 46955 - protein, 73 aa, Homo sapiens
MDVTSQARGVGLEMYPGTAQPAAPNTTSPELNLSHPLLGTALANGTGELSEHQQYVIGLFLSCLYTIFLFPIG

SEQ ID NO: 46956 - protein, 408 aa, Homo sapiens
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTHGHVMSLNCGQMWLLAPRGLARVTLAWSPWGCLGNLTTGHLALLTQNCYNPKALAPQGPKASGDQPVTQLLPANPACRCTCLPLQETFLTPSTRKATRRGHCG

SEQ ID NO: 46957 - protein, 355 aa, Homo sapiens
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDTVEFNNHTLCYNNFQKHDPDLTLIRHHVLTWVKFIIGYLFPLLTMSICYLCLIFKVKKRSILISSRHFWTILVVVVAFVVCWTPYHLFSIWELTIHHNSYSHHVMQAGIPLSTGLAFLNSCLNPILYVLISKKFQARFRSSVAEILKYTLWEVSCSGTVSEQLRNSETKNLCLLETAQ

SEQ ID NO: 46958 - protein, 74 aa, Homo sapiens
MEDLEETLFEEFENYSYDLDYYSLESDLEEKVQLGVVHWVSLVLYCLAFVLGIPGNAIVIWFTGFKWKKTVTTL

SEQ ID NO: 46959 - protein, 355 aa, Homo sapiens; identical to SEQ ID NO: 46957

SEQ ID NO: 46960 - protein, 82 aa, Homo sapiens
MEDLEETLFEEFENYSYDLDYYSLESDLEEKVQLGVVHWVSLVLYCLAFVLGIPGNAIVIWFTGFKWKKTVTTLWFLNLAIA

SEQ ID NO: 46961 - protein, 227 aa, Homo sapiens
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDTVEFNNHTLCYNNFQKHDPDLTLIRHHVLTWVKFIIGYLFPLLTMSICYL

SEQ ID NO: 46962 - protein, 137 aa, Homo sapiens
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYI

SEQ ID NO: 46963 - protein, 178 aa, Homo sapiens
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDT

SEQ ID NO: 46964 - protein, 19 aa, Homo sapiens
MEDLEETLFEEFENYSYDL

SEQ ID NO: 46965 - protein, 508 aa, Homo sapiens
MTSTCTNSTRESNSSHTCMPLSKMPISLAHGIIRSTVLVIFLAASFVGNIVLALVLQRKPQLLQVTNRFIFNLLVTDLLQISLVAPWVVATSVPLFWPLNSHFCTALVSLTHLFAFASVNTIVVVSVDRYLSIIHPLSYPSKMTQRRGYLLLYGTWIVAILQSTPPLYGWGQAAFDERNALCSMIWGASPSYTILSVVSFIVIPLIVMIACYSVVFCAARRQHALLYNVKRHSLEVRVKDCVENEDEEGAEKKEEFQDESEFRRQHEGEVKAKEGRMEAKDGSLKAKEGSTGTSESSVEARGSEEVRESSTVASDGSMEGKEGSTKVEENSMKADKGRTEVNQCSIDLGEDDMEFGEDDINFSEDDVEAVNIPESLPPSRRNSNSNPPLPRCYQCKAAKVIFIIIFSYVLSLGPYCFLAVLAVWVDVETQVPQWVITIIIWLFFLQCCIHPYVYGYMHKTIKKEIQDMLKKFFCKEKPPKEDSHPDLPGTEGGTEGKIVPSYDSATFP

SEQ ID NO: 46966 - protein, 695 aa, Homo sapiens
MKMKSQATMICCLVFFLSTECSHYRSKIHLKAGDKLQSPEGKPKTGRIQEKCEGPCISSSNCSQPCAKDFHGEIGFTCNQKKWQKSAETCTSLSVEKLFKDSTGASRLSVAAPSIPLHILDFRAPETIESVAQGIRKNCPFDYACITDMVKSSETTSGNIAFIVELLKNISTDLSDNVTREKMKSYSEVANHILDTAAISNWAFIPNKNASSDLLQSVNLFARQLHIHNNSENIVNELFIQTKGFHINHNTSEKSLNFSMSMNNTTEDILGMVQIPRQELRKLWPNASQAISIAFPTLGAILREAHLQNVSLPRQVNGLVLSVVLPERLQEIILTFEKINKTRNARAQCVGWHSKKRRWDEKACQMMLDIRNEVKCRCNYTSVVMSFSILMSSKSMTDKVLDYITCIGLSVSILSLVLCLIIEATVWSRVVVTEISYMRHVCIVNIAVSLLTANVWFIIGSHFNIKAQDYNMCVAVTFFSHFFYLSLFFWMLFKALLIIYGILVIFRRMMKSRMMVIGFAIGYGCPLIIAVTTVAITEPEKGYMRPEACWLNWDNTKALLAFAIPAFVIVAVNLIVVLVVAVNTQRPSIGSSKSQDVVIIMRISKNVAILTPLLGLTWGFGIATLIEGTSLTFHIIFALLNAFQGFFILLFGTIMDHKIRDALRMRMSSLKGKSRAAENASLGPTNGSKLMNRQG

SEQ ID NO: 46967 - protein, 695 aa, Homo sapiens; identical to SEQ ID NO: 46966

SEQ ID NO: 46968 - protein, 752 aa, Homo sapiens
MYTGPCKVLHLSSGLLPNSGRFGIVLSDEYQVVTSLWCQLYTTHAPQQASGMLLLNYLVIPSKAQVNKPGYIPNLGECSHYRSKIHLKAGDKLQSPEGKPKTGRIQEKCEGPCISSSNCSQPCAKDFHGEIGFTCNQKKWQKSAETCTSLSVEKLFKDSTGASRLSVAAPSIPLHILDFRAPETIESVAQGIRKNCPFDYACITDMVKSSETTSGNIAFIVELLKNISTDLSDNVTREKMKSYSEVANHILDTAAISNWAFIPNKNASSDLLQSVNLFARQLHIHNNSENIVNELFIQTKGFHINHNTSEKSLNFSMSMNNTTEDILGMVQIPRQELRKLWPNASQAISIAFPTLGAILREAHLQNVSLPRQVNGLVLSVVLPERLQEIILTFEKINKTRNARAQCVGWHSKKRRWDEKACQMMLDIRNEVKCRCNYTSVVMSFSILMSSKSMTDKVLDYITCIGLSVSILSLVLCLIIEATVWSRVVVTEISYMRHVCIVNIAVSLLTANVWFIIGSHFNIKAQDYNMCVAVTFFSHFFYLSLFFWMLFKALLIIYGILVIFRRMMKSRMMVIGFAIGYGCPLIIAVTTVAITEPEKGYMRPEACWLNWDNTKALLAFAIPAFVIVAVNLIVVLVVAVNTQRPSIGSSKSQDVVIIMRISKNVAILTPLLGLTWGFGIATLIEGTSLTFHIIFALLNAFQGFFILLFGTIMDHKIRDALRMRMSSLKGKSRAAENASLGPTNGSKLMNRQG

SEQ ID NO: 46969 - protein, 334 aa, Homo sapiens
MNEDLKVNLSGLPRDYLDAAAAENISAAVSSRVPAVEPEPELVVNPWDIVLCTSGTLISCENAIVVLIIFHNPSLRAPMFLLIGSLALADLLAGIGLITNFVFAYLLQSEATKLVTIGLIVASFSASVCSLLAITVDRYLSLYYALTYHSERTVTFTYVMLVMLWGTSICLGLLPVMGWNCLRDESTCSVVRPLTKNNAAILSVSFLFMFALMLQLYIQICKIVMRHAHQIALQHHFLATSHYVTTRKGVSTLAIILGTFAACWMPFTLYSLIADYTYPSIYTYATLLPATYNSIINPVIYAFRNQEIQKALCLICCGCIPSSLAQRARSPSDV

SEQ ID NO: 46970 - protein, 334 aa, Homo sapiens; identical to SEQ ID NO: 46969

SEQ ID NO: 46971 - protein, 1279 aa, Homo sapiens
MRGHGNHSRLKSRCASLGNVHHHQAQMAHGAHCRGGRTPQSPDSRGPTAGGHTRGRWTYRPIEALINVSFPGAKGGRTAEGEPSWAWVFRSGYLQRQALPGLPVSTRVAACWWQHHPGRDSGFLGPGFIDLLREEPSGRADGKAAAQKTGRLYLFPTFLGNKLPEAADSFGEIASGNSVIFTSVLQSSHPPGTPPPSARKPSPGAAMLVCEETLELGAQGCWGSTSPRGQAVSLVGGPTAGGSRLGGAGCTMGLLMALQARRPRDGTWADPRRCSRAVEGSGLTRAALVSPGPSGVEEDTRREGCVLVGSWRSSTHRSRVLIINTPSGRTPWSQGSLGSTGRYNQTRAPGSQQQGLCSDAALHEDFVPEPTPAFFQYPPQAFSKTKVRDLGRGGLYAFSKEEKVSEAQRVEAYETHGLGLSTGRQNPVPSPCKPGCVCQGLALDAEAWPRHPGRRPCAAKEACLGPPGCSGELSLPEEEGIAPGAATAAPAWVPHGRVSRFLTVKLFTYVTMYQCKQERILRLCISGESGRYVRRSRFRNFAALMVSTGVPGVLQLGARPLRGGGHPYGDSQAGKVVEWRAGDRASGLSAGERRFLSQSELQTWPRTPHCVGKKVPQPVGAADLAPDTSLCRKEGSSASRSCRPGPGHLTRREEDSFRQLAFPRFEEVTFPPLTAAERAPSVHGGHSLASQGLVLAGRTRSVASGGKQELSGPLAACIPTQDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTACWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 46972 - protein, 464 aa, Homo sapiens
MLWIGVTARNIYKQVTKKAPLCLDTDQPPYPRQPLLSRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 46973 - protein, 560 aa, Homo sapiens
MDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 46974 - protein, 853 aa, Homo sapiens
MRGHGNHSRLKSRCASLGNVHHHQAQMAHGAHCRGGRTPQSPDSRGPTAGGHTRGRWTYRPIEALINVSFPGAKGGRTAEGEPSWAWVFRSGYLQRQALPGLPVSTRVAACWWQHHPGRDSGFLGPGFIDLLREEPSGRADGKAAAQKTGRLYLFPTFLGNKLPEAADSFGEIASGNSVIFTSVLQSSHPPGTPPPSARKPSPGAAMLVCEETLELGAQGCWGSTSPRGQAVSLVGGPTAGGSRLGGAGCTMGLLMALQARRPRDGTWADPRRCSRAVEGSGLTRAALVSPGPSGVEEDTRREGCVLVGSWRSSTHRSRVLIINTPSGRTPWSQGSLGSTGRYNQTRAPGSQQQGLCSDAALHEDFVPEPTPAFFQYPPQAFSKTKVRDLGRGGLYAFSKEEKVSEAQRVEAYETHGLGLSTGRQNPVPSPCKPGCVCQGLALDAEAWPRHPGRRPCAAKEACLGPPGCSGELSLPEEEGIAPGAATAAPAWVPHGRVSRFLTVKLFTYVTMYQCKQERILRLCISGESGRYVRRSRFRNFAALMVSTGVPGVLQLGARPLRGGGHPYGDSQAGKVVEWRAGDRASGLSAGERRFLSQSELQTWPRTPHCVGKKVPQPVGAADLAPDTSLCRKEGSSASRSCRPGPGHLTRREEDSFRQLAFPRFEEVTFPPLTAAERAPSVHGGHSLASQGLVLAGRTRSVASGGKQELSGPLAACIPTQDLKTVLSLPRYPGEFLHPVVYACTAVMLLCLLASFVTYIVHQSAIRISRKGRHTLLNFCFHAAEHPGVTPLRTSPPLPWWTPIQVGIVLHYSTLSTMLWIGVTARNIYKQVTKKAPLCLDTDQPPYPRQPLL

SEQ ID NO: 46975 - protein, 1121 aa, Homo sapiens
MGAGGRRMRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 46976 - protein, 1338 aa, Homo sapiens
MGAGGRRMRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 46977 - protein, 1256 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQRGAGDHALPVLGHVGLRGSGSVPALAAPGGVQLLVRGGSLRPGPLRLHSPLCQAEGRESLVARLLPPCLSRGPPCPAPGPARRRRGRFPGVRGGPPLPQVLPKRQQRPSAGSGPLQAHQPAAGPESGVRGGGGGRRGRRAGAGGHPGKPRPPPPQQRAPRASGAQEPGQGTPRGGGLRQEPAQGPARGRGGGAGAAVQRERQSAQQPHRQLPGQQPQQPGRRPAAGRRAHAHAVRGQRHQRRAAF

SEQ ID NO: 46978 - protein, 1321 aa, Homo sapiens
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 46979 - protein, 616 aa, Homo sapiens
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKVCYILQSFKTIYS

SEQ ID NO: 46980 - protein, 381 aa, Homo sapiens
MPLKRNNSKYPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKGKFR

SEQ ID NO: 46981 - protein, 1221 aa, Homo sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQATVNSPSTTPPTVTTNMPVTNRIDKQRNDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 46982 - protein, 1193 aa, Homo sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 46983 - protein, 1222 aa, Homo sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDSASMDKSLSKLAHADGDQTSIIPVHQVIDKVKGYCNAHSDNFYKNIIMSDTFSHSTKF

SEQ ID NO: 46984 - protein, 1250 aa, Homo sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQATVNSPSTTPPTVTTNMPVTNRIDKQRNDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDSASMDKSLSKLAHADGDQTSIIPVHQVIDKVKGYCNAHSDNFYKNIIMSDTFSHSTKF

SEQ ID NO: 46985 - protein, 797 aa, Homo sapiens
MASCRAWNLRVLVAVVCGLLTGIILGLGIWRIVIRIQRGKSTSSSSTPTEFCRNGGTWENGRCICTEEWKGLRCTIANFCENSTYMGFTFARIPVGRYGPSLQTCGKDTPNAGNPMAVRLCSLSLYGEIELQKVTIGNCNENLETLEKQVKDVTAPLNNISSEVQILTSDANKLTAENITSATRVVGQIFNTSRNASPEAKKVAIVTVSQLLDASEDAFQRVAATANDDALTTLIEQMETYSLSLGNQSVVEPNIAIQSANFSSENAVGPSNVRFSVQKGASSSLVSSSTFIHTNVDGLNPDAQTELQVLLNMTKNYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 46986 - protein, 502 aa, Homo sapiens
MPVKMLFKELLLLLMMMPLQHYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 46987 - protein, 380 aa, Homo sapiens
MCPMLLKNGYNGNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 46988 - protein, 371 aa, Homo sapiens
MPGNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 46989 - protein, 380 aa, Homo sapiens; identical to SEQ ID NO: 46987

SEQ ID NO: 46990 - protein, 10 aa, Homo sapiens
MCPMLLKNGY

SEQ ID NO: 46991 - protein, 874 aa, Homo sapiens
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 46992 - protein, 228 aa, Homo sapiens
  MOD_RES (1)..(1): Any amino acid
XHGVSARDVLESRTRKQHSEATNSSNRVFVYCAFLDFSSGEGVWSNHGCALTRGNLTYSVCRCTHLTNFAILMQVVPLEVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 46993 - protein, 906 aa, Homo sapiens
MEKLLRLCCWYSWLLLFYYNFQVRGVYSRSQDHPGFQVLASASHYWPLENVDGIHELQDTTGASRTHKLTVLPSRNATFVYSNDSAYSNLSATVDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 46994 - protein, 424 aa, Homo sapiens
MTQAGRRGPGTPEPRPRTQPMASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENPASGKVSQVGGQTSDEALSMLSEGSDASTIEIHTASESCNKNEGDPALPTHGDL

SEQ ID NO: 46995 - protein, 171 aa, Homo sapiens
MVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLII

SEQ ID NO: 46996 - protein, 287 aa, Homo sapiens
  MOD_RES (1)..(1): Any amino acid
XTAGPVTGSASRGPARGPKGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENP

SEQ ID NO: 46997 - protein, 404 aa, Homo sapiens
MASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENPASGKVSQVGGQTSDEALSMLSEGSDASTIEIHTASESCNKNEGDPALPTHGDL

SEQ ID NO: 46998 - protein, 360 aa, Homo sapiens
MDPEETSVYLDYYYATSPNSDIRETHSHVPYTSVFLPVFYTAVFLTGVLGNLVLMGALHFKPGSRRLIDIFIINLAASDFIFLVTLPLWVDKEASLGLWRTGSFLCKGSSYMISVNMHCSVLLLTCMSVDRYLAIVWPVVSRKFRRTDCAYVVCASIWFISCLLGLPTLLSRELTLIDDKPYCAEKKATPIKLIWSLVALIFTFFVPLLSIVTCYCCIARKLCAHYQQSGKHNKKLKKSIKIIFIVVAAFLVSWLPFNTFKFLAIVSGLRQEHYLPSAILQLGMEVSGPLAFANSCVNPFIYYIFDSYIRRAIVHCLCPCLKNYDFGSSTETSDSHLTKALSTFIHAEDFARRRKRSVSL

SEQ ID NO: 46999 - protein, 609 aa, Homo sapiens
MSDERRLPGSAVGWLVCGGLSLLANAWGILSVGAKQKKWKPLEFLLCTLAATHMLNVAVPIATYSVVQLRRQRPDFEWNEGLCKVFVSTFYTLTLATCFSVTSLSYHRMWMVCWPVNYRLSNAKKQAVHTVMGIWMVSFILSALPAVGWHDTSERFYTHGCRFIVAEIGLGFGVCFLLLVGGSVAMGVICTAIALFQTLAVQVGRQADRRAFTVPTIVVEDAQGKRRSSIDGSEPAKTSLQTTGLVTTIVFIYDCLMGFPVLVVSFSSLRADASAPWMALCVLWCSVAQALLLPVFLWACDRYRADLKAVREKCMALMANDEESDDETSLEGGISPDLVLERSLDYGYGGDFVALDRMAKYEISALEGGLPQLYPLRPLQEDKMQYLQVPPTRRFSHDDADVWAAVPLPAFLPRWGSGEDLAALAHLVLPAGPERRRASLLAFAEDAPPSRARRRSAESLLSLRPSALDSGPRGARDSPPGSPRRRPGPGPRSASASLLPDAFALTAFECEPQALRRPPGPFPAAPAAPDGADPGEAPTPPSSAQRSPGPRPSAHSHAGSLRPGLSASWGEPGGLRAAGGGGSTSSFLSSPSESSGYATLHSDSLGSAS

SEQ ID NO: 47000 - protein, 814 aa, Homo sapiens
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 47001 - protein, 814 aa, Homo sapiens; identical to SEQ ID NO: 47000

SEQ ID NO: 47002 - protein, 810 aa, Homo sapiens
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 47003 - protein, 529 aa, Homo sapiens
MSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 47004 - protein, 529 aa, Homo sapiens; identical to SEQ ID NO: 47003

SEQ ID NO: 47005 - protein, 529 aa, Homo sapiens; identical to SEQ ID NO: 47003

SEQ ID NO: 47006 - protein, 529 aa, Homo sapiens; identical to SEQ ID NO: 47003

SEQ ID NO: 47007 - protein, 549 aa, Homo sapiens
MSARGVVQHALPTPRRGALTMSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 47008 - protein, 451 aa, Homo sapiens
MGGRRCVPGTLPMRAAPPGAKRLHVPLRAKGVGRSGHAPRLESVRTSYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 47009 - protein, 415 aa, Homo sapiens
MLVPVGWMNESYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 47010 - protein, 367 aa, Homo sapiens
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLYAHLACAFLWVVVAVAMAPLLVSPQTVQTNHTVVCLQLYREKASHHALVSLAVAFTFPFITTVTCYLLIIRSLRQGLRVEKRLKTKAVRMIAIVLAIFLVCFVPYHVNRSVYVLHYRSHGASCATQRILALANRITSCLTSLNGALDPIMYFFVAEKFRHALCNLLCGKRLKGPPPSFEGKTNESSLSAKSEL

SEQ ID NO: 47011 - protein, 103 aa, Homo sapiens
MNGLEVAPPGLITNFSLATAEQCGQETPLENMLFASFYLPLPRQPRMCTVTGLTAGSTARSKQHLEVVFAVLPAFKLQRGRRERTSKPPIIPMSSPGPCWVRT

SEQ ID NO: 47012 - protein, 367 aa, Homo sapiens; identical to SEQ ID NO: 47010

SEQ ID NO: 47013 - protein, 136 aa, Homo sapiens
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTG

SEQ ID NO: 47014 - protein, 367 aa, Homo sapiens; identical to SEQ ID NO: 47010

SEQ ID NO: 47015 - protein, 445 aa, Homo sapiens
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 47016 - protein, 445 aa, Homo sapiens; identical to SEQ ID NO: 47015

SEQ ID NO: 47017 - protein, 445 aa, Homo sapiens; identical to SEQ ID NO: 47015

SEQ ID NO: 47018 - protein, 445 aa, Homo sapiens; identical to SEQ ID NO: 47015

SEQ ID NO: 47019 - protein, 445 aa, Homo sapiens; identical to SEQ ID NO: 47015

SEQ ID NO: 47020 - protein, 357 aa, Homo sapiens
MVGTALLASLWHHVAPVAGQLHSVAFLALAFVLALACCASNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 47021 - protein, 448 aa, Homo sapiens
MAAPTLGRLVLTHLLVALFGMGSWAAVNGIWVELPVVVKDLPEGWSLPSYLSVVVALGNLGLLVVTLWRQLAPGKGEQVPIQVVQVLSVVGTALLAPLWHHVAPVAGQLHSVAFLTLALVLAMACCTSNVTFLPFLSHLPPPFLRSFFLGQGLSALLPCVLALVQGVGRLECPPAPTNGTSGPPLDFPERFPASTFFWALTALLVTSAAAFRGLLLLLPSLPSVTTGGSGPELQLGSPGAEEEEKEEEEALPLQEPPSQAAGTIPGPDPEAHQLFSAHGAFLLGLMAFTSAVTNGVLPSVQSFSCLPYGRLAYHLAVVLGSAANPLACFLAMGVLCRSLAGLVGLSLLGMLFGAYLMALAILSPCPPLVGTTAGVVLVVLSWVLCLCVFSYVKVAASSLLHGGGRPALLAAGVAIQVGSLLGAGAMFPPTSIYHVFQSRKDCVDPCGP

SEQ ID NO: 47022 - protein, 448 aa, Homo sapiens; identical to SEQ ID NO: 47021

SEQ ID NO: 47023 - protein, 350 aa, Homo sapiens
MAAPTLGRLVLTHLLVALFGMGSWAAVNGIWVELPVVVKDLPEGWSLPSYLSVVVALGNLGLLVVTLWRQLAPGKGEQVPIQVVQVLSVVGTALLAPLWHHVAPVAGQLHSVAFLTLALVLAMACCTSNVTFLPFLSHLPPPFLRSFFLGQGLSALLPCVLALVQGVGRLECPPAPTNGTSGPPLDFPERFPASTFFWALTALLVTSAAAFRGLLLLLPSLPSVTTGGSGPELQLGSPGAEEEEKEEEEALPLQEPPSQAAGTIPGPDPEAHQLFSAHGAFLLGLMAFTSAVTNGVLPSVQSFSCLPYGRLAYHLAVVLGSAANPLACFLAMGVLCRCCRGCCVCVCSHM

SEQ ID NO: 47024 - protein, 470 aa, Homo sapiens
MPAPLLLISRTLGNFMVLWSTCRTTVFKSVTNRFIKNLACSGICASLVCVPFDIILSTSPHCCWWIYTMLFCKVVKFLHKVFCSVTILSFPAIALDRYYSVLYPLERKISDAKSRELVMYIWAHAVVASVPVFAVTNVADIYATSTCTEVWSNSLGHLVYVLVYNITTVIVPVVVVFLFLILIRRALSASQKKKVIIAALRTPQNTISIPYASQREAELHATLLSMVMVFILCSVPYATLVVYQTVLNVPDTSVFLLLTAVWLPKVSLLANPVLFLTVNKSVRKCLIGTLVQLHHRYSRRNVVSTGSGMAEASLEPSIRSGSQLLEMFHIGQQQIFKPTEDEEESEAKYIGSADFQAKEIFSTCLEGEQGPQFAPSAPPLSTVDSVSQVAPAAPVEPETFPDKYSLQFGFGPFELPPQWLSETRNSKKRLLPPLGNTPEELIQTKVPKVGRVERKMSRNNKVSIFPKVDS

SEQ ID NO: 47025 - protein, 515 aa, Homo sapiens
MGHNGSWISPNASEPHNASGAEAAGVNRSALGEFGEAQLYRQFTTTVQVVIFIGSLLGNFMVLWSTCRTTVFKSVTNRFIKNLACSGICASLVCVPFDIILSTSPHCCWWIYTMLFCKVVKFLHKVFCSVTILSFPAIALDRYYSVLYPLERKISDAKSRELVMYIWAHAVVASVPVFAVTNVADIYATSTCTEVWSNSLGHLVYVLVYNITTVIVPVVVVFLFLILIRRALSASQKKKVIIAALRTPQNTISIPYASQREAELHATLLSMVMVFILCSVPYATLVVYQTVLNVPDTSVFLLLTAVWLPKVSLLANPVLFLTVNKSVRKCLIGTLVQLHHRYSRRNVVSTGSGMAEASLEPSIRSGSQLLEMFHIGQQQIFKPTEDEEESEAKYIGSADFQAKEIFSTCLEGEQGPQFAPSAPPLSTVDSVSQVAPAAPVEPETFPDKYSLQFGFGPFELPPQWLSETRNSKKRLLPPLGNTPEELIQTKVPKVGRVERKMSRNNKVSIFPKVDS

SEQ ID NO: 47026 - protein, 515 aa, Homo sapiens; identical to SEQ ID NO: 47025

SEQ ID NO: 47027 - protein, 331 aa, Homo sapiens
MITLNNQDQPVPFNSSHPDEYKIAALVFYSCIFIIGLFVNITALWVFSCTTKKRTTVTIYMMNVALVDLIFIMTLPFRMFYYAKDEWPFGEYFCQILGALTVFYPSIALWLLAFISADRYMAIVQPKYAKELKNTCKAVLACVGVWIMTLTTTTPLLLLYKDPDKDSTPATCLKISDIIYLKAVNVLNLTRLTFFFLIPLFIMIGCYLVIIHNLLHGRTSKLKPKVKEKSIRIIITLLVQVLVCFMPFHICFAFLMLGTGENSYNPWGAFTTFLMNLSTCLDVILYYIVSKQFQARVISVMLYRNYLRSMRRKSFRSGSLRSLSNINSEML

SEQ ID NO: 47028 - protein, 331 aa, Homo sapiens; identical to SEQ ID NO: 47027

SEQ ID NO: 47029 - protein, 331 aa, Homo sapiens; identical to SEQ ID NO: 47027

SEQ ID NO: 47030 - protein, 98 aa, Homo sapiens
MITLNNQDQPVPFNSSHPDEYKIAALVFYSCIFIIGLFVNITALWVFSCTTKKRTTVTIYMMNVALVDLIFIMTLPFRMFYYAKDEWPFGEYFCQILG

SEQ ID NO: 47031 - protein, 361 aa, Homo sapiens [sequence omitted]

SEQ ID NO: 47032 - protein, 415 aa, Homo sapiens
MVFAHRMDNSKPHLIIPTLLVPLQNRSCTETATPLPSQYLMELSEEHSWMSNQTDLHYVLKPGEVATASIFFGILWLFSIFGNSLVCLVIHRSRRTQSTTNYFVVSMACADLLISVASTPFVLLQFTTGRWTLGSATCKVVRYFQYLTPGVQIYVLLSICIDRFYTIVYPLSFKVSREKAKKMIAASWVFDAGFVTPVLFFYGSNWDSHCNYFLPSSWEGTAYTVIHFLVGFVIPSVLIILFYQKVIKYIWRIGTDGRTVRRTMNIVPRTKVKTIKMFLILNLLFLLSWLPFHVAQLWHPHEQDYKKSSLVFTAITWISFSSSASKPTLYSIYNANFRRGMKETFCMSSMKCYRSNAYTITTSSRMAKKNYVGISEIPSMAKTITKDSIYDSFDREAKEKKLAWPINSNPPNTFV

SEQ ID NO: 47033 - protein, 415 aa, Homo sapiens; identical to SEQ ID NO: 47032

SEQ ID NO: 47034 - protein, 59 aa, Homo sapiens
MVFAHRMDNSKPHLIIPTLLVPLQNRSCTETATPLPSQYLMELSEEHSWMSNQTDLHYV

SEQ ID NO: 47035 - protein, 358 aa, Homo sapiens
MPSVSPAGPSAGAVPNATAVTTVRTNASGLEVPLFHLFARLDEELHGTFPGLWLALMAVHGAIFLAGLVLNGLALYVFCCRTRAKTPSVIYTINLVVTDLLVGLSLPTRFAVYYGARGCLRCAFPHVLGYFLNMHCSILFLTCICVDRYLAIVRPEGSRRCRQPACARAVCAFVWLAAGAVTLSVLGVTGSRPCCRVFALTVLEFLLPLLVISVFTGRIMCALSRPGLLHQGRQRRVRAMQLLLTVLIIFLVCFTPFHARQVAVALWPDMPHHTSLVVYHVAVTLSSLNSCMDPIVYCFVTSGFQATVRGLFGQHGEREPSSGDVVSMHRSSKGSGRHHILSAGPHALTQALANGPEA

SEQ ID NO: 47036 - protein, 349 aa, Homo sapiens
MNSTLDGNQSSHPFCLLAFGYLETVNFCLLEVLIIVFLTVLIISGNIIVIFVFHCAPLLNHHTTSYFIQTMAYADLFVGVSCVVPSLSLLHHPLPVEESLTCQIFGFVVSVLKSVSMASLACISIDRYIAITKPLTYNTLVTPWRLRLCIFLIWLYSTLVFLPSFFHWGKPGYHGDVFQWCAESWHTDSYFTLFIVMMLYAPAALIVCFTYFNIFRICQQHTKDISERQARFSSQSGETGEVQACPDKRYAMVLFRITSVFYILWLPYIIYFLLESSTGHSNRFASFLTTWLAISNSFCNCVIYSLSNSVFQRGLKRLSGAMCTSCASQTTANDPYTVRSKGPLNGCHI

SEQ ID NO: 47037 - protein, 250 aa, Homo sapiens [sequence omitted]

SEQ ID NO: 47038 - protein, 433 aa, Homo sapiens
MCFSPILEINMQSESNITVRDDIDDINTNMYQPLSYPLSFQVSLTGFLMLEIVLGLGSNLTVLVLYCMKSNLINSVSNIITMNLHVLDVIICVGCIPLTIVILLLSLESNTALICCFHEACVSFASVSTAINVFAITLDRYDISVKPANRILTMGRAVMLMISIWIFSFFSFLIPFIEVNFFSLQSGNTWENKTLLCVSTNEYYTELGMYYHLLVQIPIFFFTVVVMLITYTKILQALNIRIGTRFSTGQKKKARKKKTISLTTQHEATDMSQSSGGRNVVFGVRTSVSVIIALRRAVKRHRERRERQKRVFRMSLLIISTFLLCWTPISVLNTTILCLGPSDLLVKLRLCFLVMAYGTTIFHPLLYAFTRQKFQKVLKSKMKKRVVSIVEADPLPNNAVIHNSWIDPKRNKKITFEDSEIREKCLVPQVVTD

SEQ ID NO: 47039 - protein, 361 aa, Homo sapiens
MAPTEPWSPSPGSAPWDYSGLDGLEELELCPAGDLPYGYVYIPALYLAAFAVGLLGNAFVVWLLAGRRGPRRLVDTFVLHLAAADLGFVLTLPLWAAAAALGGRWPFGDGLCKLSSFALAGTRCAGALLLAGMSVDRYLAVVKLLEARPLRTPRCALASCCGVWAVALLAGLPSLVYRGLQPLPGGQDSQCGEEPSHAFQGLSLLLLLLTFVLPLVVTLFCYCRISRRLRRPPHVGRARRNSLRIIFAIESTFVGSWLPFSALRAVFHLARLGALPLPCPLLLALRWGLTIATCLAFVNSCANPLIYLLLDRSFRARALDGACGRTGRLARRISSASSLSRDDSSVFRCRAQAANTASASW

SEQ ID NO: 47040 - protein, 337 aa, Homo sapiens
MNSWDAGLAGLLVGTMGVSLLSNALVLLCLLHSADIRRQAPALFTLNLTCGNLLCTVVNMPLTLAGVVAQRQPAGDRLCRLAAFLDTFLAANSMLSMAALSIDRWVAVVFPLSYRAKMRLRDAALMVAYTWLHALTFPAAALALSWLGFHQLYASCTLCSRRPDERLRFAVFTGAFHALSFLLSFVVLCCTYLKVLKVARFHCKRIDVITMQTLVLLVDLHPSVRERCLEEQKRRRQRATKKISTFIGTFLVCFAPYVITRLVELFSTVPIGSHWGVLSKCLAYSKAASDPFVYSLLRHQYRKSCKEILNRLLHRRSIHSSGLTGDSHSQNILPVSE

SEQ ID NO: 47041 - protein, 375 aa, Homo sapiens
MANASEPGGSGGGEAAALGLKLATLSLLLCVSLAGNVLFALLIVRERSLHRAPYYLLLDLCLADGLRALACLPAVMLAARRAAAAAGAPPGALGCKLLAFLAALFCFHAAFLLLGVGVTRYLAIAHHRFYAERLAGWPCAAMLVCAAWALALAAAFPPVLDGGGDDEDAPCALEQRPDGAPGALGFLLLLAVVVGATHLVYLRLLFFIHDRRKMRPARLVPAVSHDWTFHGPGATGQAAANWTAGFGRGPTPPALVGIRPAGPGRGARRLLVLEEFKTEKRLCKMFYAVTLLFLLLWGPYVVASYLRVLVRPGAVPQAYLTASVWLTFAQAGINPVVCFLFNRELRDCFRAQFPCCQSPRTTQATHPCDLKGIGL

SEQ ID NO: 47042 - protein, 330 aa, Homo sapiens
MMWGAGSPLAWLSAGSGNVNVSSVGPAEGPTGPAAPLPSPKAWDVVLCISGTLVSCENALVVAIIVGTPAFRAPMFLLVGSLAVADLLAGLGLVLHFAAVFCIGSAEMSLVLVGVLAMAFTASIGSLLAITVDRYLSLYNALTYYSETTVTRTYVMLALVWGGALGLGLLPVLAWNCLDGLTTCGVVYPLSKNHLVVLAIAFFMVFGIMLQLYAQICRIVCRHAQQIALQRHLLPASHYVATRKGIATLAVVLGAFAACWLPFTVYCLLGDAHSPPLYTYLTLLPATYNSMINPIIYAFRNQDVQKVLWAVCCCCSSSKIPFRSRSPSDV

SEQ ID NO: 47043 - protein, 319 aa, Homo sapiens
MPFPNCSAPSTVVATAVGVLLGLECGLGLLGNAVALWTFLFRVRVWKPYAVYLLNLALADLLLAACLPFLAAFYLSLQAWHLGRVGCWALHFLLDLSRSVGMAFLAAVALDRYLRVVHPRLKVNLLSPQAALGVSGLVWLLMVALTCPGLLISEAAQNSTRCHSFYSRADGSFSIIWQEALSCLQFVLPFGLIVFCNAGIIRALQKRLREPEKQPKLQRAQALVTLVVVLFALCFLPCFLARVLMHIFQNLGSCRALCAVAHTSDVTGSLTYLHSVLNPVVYCFSSPTFRSSYRRVFHTLRGKGQAAEPPDFNPRDSYS

SEQ ID NO: 47044 - protein, 356 aa, Homo sapiens
MNGVSEGTRGCSDRQPGVLTRDRSCSRKMNSSGCLSEEVGSLRPLTVVILSASIVVGVLGNGLVLWMTVFRMARTVSTVCFFHLALADFMLSLSLPIAMYYIVSRQWLLGEWACKLYITFVFLSYFASNCLLVFISVDRCISVLYPVWALNHRTVQRASWLAFGVWLLAAALCSAHLKFRTTRKWNGCTHCYLAFNSDNETAQIWIEGVVEGHIIGTIGHFLLGFLGPLAIIGTCAHLIRAKLLREGWVHANRPKRLLLVLVSAFFIFWSPFNVVLLVHLWRRVMLKEIYHPRMLLILQASFALGCVNSSLNPFLYVFVGRDFQEKFFQSLTSALARAFGEEEFLSSCPRGNAPRE

SEQ ID NO: 47045 - protein, 381 aa, Homo sapiens
MRSHTITMTTTSVSSWPYSSHRMRFITNHSDQPPQNFSATPNVTTCPMDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 47046 - protein, 381 aa, Homo sapiens; identical to SEQ ID NO: 47045

SEQ ID NO: 47047 - protein, 334 aa, Homo sapiens
MDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 47048 - protein, 309 aa, Homo sapiens
MNGTYNTCGSSDLTWPPAIKLGFYAYLGVLLVLGLLLNSLALWVFCCRMQQWTETRIYMTNLAVADLCLLCTLPFVLHSLRDTSDTPLCQLSQGIYLTNRYMSISLVTAIAVDRYVAVRHPLRARGLRSPRQAAAVCAVLWVLVIGSLVARWLLGIQEGGFCFRSTRHNFNSMAFPLLGFYLPLAVVVFCSLKVVTALAQRPPTDVGQAEATRKAARMVWANLLVFVVCFLPLHVGLTVRLAVGWNACALLETIRRALYITSKLSDANCCLDAICYYYMAKEFQEASALAVAPSAKAHKSQDSLCVTLA

SEQ ID NO: 47049 - protein, 309 aa, Homo sapiens; identical to SEQ ID NO: 47048

SEQ ID NO: 47050 - protein, 309 aa, Homo sapiens; identical to SEQ ID NO: 47048

SEQ ID NO: 47051 - protein, 309 aa, Homo sapiens; identical to SEQ ID NO: 47048

SEQ ID NO: 47052 - protein, 340 aa, Homo sapiens
MLSGSRAVPTPHRGSEELLKYMLHSPCVSLTMNGTYNTCGSSDLTWPPAIKLGFYAYLGVLLVLGLLLNSLALWVFCCRMQQWTETRIYMTNLAVADLCLLCTLPFVLHSLRDTSDTPLCQLSQGIYLTNRYMSISLVTAIAVDRYVAVRHPLRARGLRSPRQAAAVCAVLWVLVIGSLVARWLLGIQEGGFCFRSTRHNFNSMAFPLLGFYLPLAVVVFCSLKVVTALAQRPPTDVGQAEATRKAARMVWANLLVFVVCFLPLHVGLTVRLAVGWNACALLETIRRALYITSKLSDANCCLDAICYYYMAKEFQEASALAVAPSAKAHKSQDSLCVTLA

SEQ ID NO: 47053 - protein, 613 aa, Homo sapiens
MRAPGALLARMSRLLLLLLLKVSASSALGVAPASRNETCLGESCAPTVIQRRGRDAWGPGNSARDVLRARAPREEQGAAFLAGPSWDLPAAPGRDPAAGRGAEASAAGPPGPPTRPPGPWRWKGARGQEPSETLGRGNPTALQLFLQISEEEEKGPRGAGISGRSQEQSVKTVPGASDLFYWPRRAGKLQGSHHKPLSKTANGLAGHEGWTIALPGRALAQNGSLGEGIHEPGGPRRGNSTNRRVRLKNPFYPLTQESYGAYAVMCLSVVIFGTGIIGNLAVMCIVCHNYYMRSISNSLLANLAFWDFLIIFFCLPLVIFHELTKKWLLEDFSCKIVPYIEVASLGVTTFTLCALCIDRFRAATNVQMYYEMIENCSSTTAKLAVIWVGALLLALPEVVLRQLSKEDLGFSGRAPAERCIIKISPDLPDTIYVLALTYDSARLWWYFGCYFCLPTLFTITCSLVTARKIRKAEKACTRGNKRQIQLESQMNCTVVALTILYGFCIIPENICNIVTAYMATGVSQQTMDLLNIISQFLLFFKSCVTPVLLFCLCKPFSRAFMECCCCCCEECIQKSSTVTSDDNDNEYTTELELSPFSTIRREMSTFASVGTHC

SEQ ID NO: 47054 - protein, 453 aa, Homo sapiens
MASPSLPGSDCSQIIDHSHVPEFEVATWIKITLILVYLIIFVMGLLGNSATIRVTQVLQKKGYLQKEVTDHMVSLACSDILVFLIGMPMEFYSIIWNPLTTSSYTLSCKLHTFLFEACSYATLLHVLTLSFERYIAICHPFRYKAVSGPCQVKLLIGFVWVTSALVALPLLFAMGTEYPLVNVPSHRGLTCNRSSTRHHEQPETSNMSICTNLSSRWTVFQSSIFGAFVVYLVVLLSVAFMCWNMMQVLMKSQKGSLAGGTRPPQLRKSESEESRTARRQTIIFLRLIVVTLAVCWMPNQIRRIMAAAKPKHDWTRSYFRAYMILLPFSETFFYLSSVINPLLYTVSSQQFRRVFVQVLCCRLSLQHANHEKRLRVHAHSTTDSARFVQRPLLFASRRQSSARRTEKIFLSTFQSEAEPQSKSQSLSLESLEPNSGAKPANSAAENGFQEHEV

SEQ ID NO: 47055 - protein, 362 aa, Homo sapiens
MGNHTWEGCHVDSRVDHLFPPSLYIFVIGVGLPTNCLALWAAYRQVQQRNELGVYLMNLSIADLLYICTLPLWVDYFLHHDNWIHGPGSCKLFGFIFYTNIYISIAFLCCISVDRYLAVAHPLRFARLRRVKTAVAVSSVVWATELGANSAPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAIYLGRPWDCGFEERVFSAYHSSLAFTSLNCVADPILYCLVNEGARSDVAKALHNLLRFLASDKPQEMANASLTLETPLTSKRNSTAKAMTGSWAATPPSQGDQVQLKMLPPAQ

SEQ ID NO: 47056 - protein, 346 aa, Homo sapiens
MDTGPDQSYFSGNHWFVFSVYLLTFLVGLPLNLLALVVFVGKLRCRPVAVDVLLLNLTASDLLLLLFLPFRMVEAANGMHWPLPFILCPLSGFIFFTTIYLTALFLAAVSIERFLSVAHPLWYKTRPRLGQAGLVSVACWLLASAHCSVVYVIEFSGDISHSQGTNGTCYLEFWKDQLAILLPVRLEMAVVLFVVPLIITSYCYSRLVWILGRGGSHRRQRRVAGLVAATLLNFLVCFGPYNVSHVVGYICGESPVWRIYVTLLSTLNSCVDPFVYYFSSSGFQADFHELLRRLCGLWGQWQQESSMELKEQKGGEEQRADRPAERKTSEHSQGCGTGGQVACAEN

SEQ ID NO: 47057 - protein, 372 aa, Homo sapiens
MACNSTSLEAYTYLLLNTSNASDSGSTQLPAPLRISLAIVMLLMTVVGFLGNTVVCIIVYQRPAMRSAINLLLATLAFSDIMLSLCCMPFTAVTLITVRWHFGDHFCRLSATLYWFFVLEGVAILLIISVDRFLIIVQRQDKLNPRRAKVIIAVSWVLSFCIAGPSLTGWTLVEVPARAPQCVLGYTELPADRAYVVTLVVAVFFAPFGVMLCAYMCILNTVRKNAVRVHNQSDSLDLRQLTRAGLRRLQRQQQVSVDLSFKTKAFTTILILFVGFSLCWLPHSVYSLLSVFSQRFYCGSSFYATSTCVLWLSYLKSVFNPIVYCWRIKKFREACIELLPQTFQILPKVPERIRRRIQPSTVYVCNENQSAV

SEQ ID NO: 47058 - protein, 617 aa, Homo sapiens
MGPTLAVPTPYGCIGCKLPQPEYPPALIIFMFCAMVITIVVDLIGNSMVILAVTKNKKLRNSGNIFVVSLSVADMLVAIYPYPLMLHAMSIGGWDLSQLQCQMVGFITGLSVVGSIFNIVAIAINRYCYICHSLQYERIFSVRNTCIYLVITWIMTVLAVLPNMYIGTIEYDPRTYTCIFNYLNNPVFTVTIVCIHFVLPLLIVGFCYVRIWTKVLAARDPAGQNPDNQLAEVRNFLTMFVIFLLFAVCWCPINVLTVLVAVSPKEMAGKIPNWLYLAAYFIAYFNSCLNAVIYGLLNENFRREYWTIFHAMRHPIIFFSGLISDIREMQEARTLARARAHARDQAREQDRAHACPAVEETPMNVRNVPLPGDAAAGHPDRASGHPKPHSRSSSAYRKSASTHHKSVFSHSKAASGHLKPVSGHSKPASGHPKSATVYPKPASVHFKADSVHFKGDSVHFKPDSVHFKPASSNPKPITGHHVSAGSHSKSAFSAATSHPKPTTGHIKPATSHAEPTTADYPKPATTSHPKPTAADNPELSASHCPEIPAIAHPVSDDSDLPESASSPAAGPTKPAASQLESDTIADLPDPTVVTTSTNDYHDVVVIDVEDDPDEMAV

SEQ ID NO: 47059 - protein, 194 aa, Homo sapiens
MVILAVTKNKKLRNSGNIFVVSLSVADMLVAIYPYPLMLHAMSIGGWDLSQLQCQMVGFITGLSVVGSIFNIVAIAINRYCYICHSLQYERIFSVRNTCIYLVITWIMTVLAVLPNMYIGTIEYDPRTYTCIFNYLNNPVFTVTIVCIHFVLPLLIVGFCYVRIWTKVLAARDPAGQNPDNQLAEPTSTAASTL

SEQ ID NO: 47060 - protein, 361 aa, Homo sapiens
MNESRWTEWRILNMSSGIVNVSERHSCPLGFGHYSVVDVCIFETVVIVLLTFLIIAGNLTVIFVFHCAPLLHHYTTSYFIQTMAYADLFVGVSCLVPTLSLLHYSTGVHESLTCQVFGYIISVLKSVSMACLACISVDRYLAITKPLSYNQLVTPCRLRICIILIWIYSCLIFLPSFFGWGKPGYHGDIFEWCATSWLTSAYFTGFIVCLLYAPAAFVVCFTYFHIFKICRQHTKEINDRRARFPSHEVDSSRETGHSPDRRYAMVLFRITSVFYMLWLPYIIYFLLESSRVLDNPTLSFLTTWLAISNSFCNCVIYSLSNSVFRLGLRRLSETMCTSCMCVKDQEAQEPKPRKRANSCSI

SEQ ID NO: 47061 - protein, 319 aa, Homo sapiens
MSQQNTSGDCLFDGVNELMKTLQFAVHIPTFVLGLLLNLLAIHGFSTFLKNRWPDYAATSIYMINLAVFDLLLVLSLPFKMVLSQVQSPFPSLCTLVECLYFVSMYGSVFTICFISMDRFLAIRYPLLVSHLRSPRKIFGICCTIWVLVWTGSIPIYSFHGKVEKYMCFHNMSDDTWSAKVFFPLEVFGFLLPMGIMGFCCSRSIHILLGRRDHTQDWVQQKACIYSIAASLAVFVVSFLPVHLGFFLQFLVRNSFIVECRAKQSISFFLQLSMCFSNVNCCLDVFCYYFVIKEFRMNIRAHRPSRVQLVLQDTTISRG

SEQ ID NO: 47062 - protein, 319 aa, Homo sapiens; identical to SEQ ID NO: 47061

SEQ ID NO: 47063 - protein, 242 aa, Homo sapiens
MSQQNTSGDCLFDGVNELMKTLQFAVHIPTFVLGLLLNLLAIHGFSTFLKNRWPDYAATSIYMINLAVFDLLLVLSLPFKMVLSQVQSPFPSLCTLVECLYFVSMYGSVFTICFISMDRFLAIRYPLLVSHLRSPRKIFGICCTIWVLVWTGSIPIYSFHGKVEKYMCFHNMSDDTWSAKVFFPLEVFGFLLPMGIMGFCCSRSIHILLGRRDHTQDWVQQKACIYSIAASLAVFVVSFLPV

SEQ ID NO: 47064 - protein, 319 aa, Homo sapiens; identical to SEQ ID NO: 47061

SEQ ID NO: 47065 - protein, 523 aa, Homo sapiens
MTPQSLLQTTLFLLSLLFLVQGAHGRGHREDFRFCSQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 47066 - protein, 693 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 47067 - protein, 693 aa, Homo sapiens; identical to SEQ ID NO: 47066

SEQ ID NO: 47068 - protein, 687 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 47069 - protein, 693 aa, Homo sapiens; identical to SEQ ID NO: 47066

SEQ ID NO: 47070 - protein, 687 aa, Homo sapiens; identical to SEQ ID NO: 47068

SEQ ID NO: 47071 - protein, 687 aa, Homo sapiens; identical to SEQ ID NO: 47068

SEQ ID NO: 47072 - protein, 512 aa, Homo sapiens
MCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 47073 - protein, 687 aa, Homo sapiens; identical to SEQ ID NO: 47068

SEQ ID NO: 47074 - protein, 687 aa, Homo sapiens; identical to SEQ ID NO: 47068

SEQ ID NO: 47075 - protein, 362 aa, Homo sapiens
MNASAASLNDSQVVVVAAEGAAAAATAAGGPDTGEWGPPAAAALGAGGGANGSLELSSQLSAGPPGLLLPAVNPWDVLLCVSGTVIAGENALVVALIASTPALRTPMFVLVGSLATADLLAGCGLILHFVFQYLVPSETVSLLTVGFLVASFAASVSSLLAITVDRYLSLYNALTYYSRRTLLGVHLLLAATWTVSLGLGLLPVLGWNCLAERAACSVVRPLARSHVALLSAAFFMVFGIMLHLYVRICQVVWRHAHQIALQQHCLAPPHLAATRKGVGTLAVVLGTFGASWLPFAIYCVVGSHEDPAVYTYATLLPATYNSMINPIIYAFRNQEIQRALWLLLCGCFQSKVPFRSRSPSEV

SEQ ID NO: 47076 - protein, 377 aa, Homo sapiens
MTLLAWCTRGANPAAMNASAASLNDSQVVVVAAEGAAAAATAAGGPDTGEWGPPAAAALGAGGGANGSLELSSQLSAGPPGLLLPAVNPWDVLLCVSGTVIAGENALVVALIASTPALRTPMFVLVGSLATADLLAGCGLILHFVFQYLVPSETVSLLTVGFLVASFAASVSSLLAITVDRYLSLYNALTYYSRRTLLGVHLLLAATWTVSLGLGLLPVLGWNCLAERAACSVVRPLARSHVALLSAAFFMVFGIMLHLYVRICQVVWRHAHQIALQQHCLAPPHLAATRKGVGTLAVVLGTFGASWLPFAIYCVVGSHEDPAVYTYATLLPATYNSMINPIIYAFRNQEIQRALWLLLCGCFQSKVPFRSRSPSEV

SEQ ID NO: 47077 - protein, 340 aa, Homo sapiens
MNASAASLNDSQVVVVAAEGAAAAATAAGGPDTGEWGPPAAAALGAGGGANGSLELSSQLSAGPPGLLLPAVNPWDVLLCVSGTVIAGENALVVALIASTPALRTPMFVLVGSLATADLLAGCGLILHFVFQYLVPSETVSLLTVGFLVASFAASVSSLLAITVDRYLSLYNALTYYSRRTLLGVHLLLAATWTVSLGLGLLPVLGWNCLAERAACSVVRPLARSHVALLSAAFFMVFGIMLHLYVRICQVVWRHAHQIALQQHCLAPPHLAATRKGVGTLAVVLGTFGASWLPFATYNSMINPIIYAFRNQEIQRALWLLLCGCFQSKVPFRSRSPSEV

SEQ ID NO: 47078 - protein, 579 aa, Homo sapiens
NPRLTVLERVEGYGEQEWQKGDGKGRGEGHSESGVLSGSGSCTSHVSCFLAVTKADPAATSGQKGDELLILQLPGLALCTQTNLPKRLQWEVPPTKPGSLGLGSPSQGRWTRMGDGPQEVPWVPSFGPMESSPIPQSSGNSSTLGRVPQTPGPSTASGVPEVGLRDVASESVALFFMLLLDLTAVAGNAAVMAVIAKTPALRKFVFVFHLCLVDLLAALTLMPLAMLSSSALFDHALFGEVACRLYLFLSVCFVSLAILSVSAINVERYYYVVHPMRYEVRMTLGLVASVLVGVWVKALAMASVPVLGRVSWEEGAPSVPPGCSLQWSHSAYCQLFVVVFAVLYFLLPLLLILVVYCSMFRVARVAAMQHGPLPTWMETPRQRSESLSSRSTMVTSSGAPQTTPHRTFGGGKAAVVLLAVGGQFLLCWLPYFSFHLYVALSAQPISTGQVESVVTWIGYFCFTSNPFFYGCLNRQIRGELSKQFVCFFKPAPEEELRLPSREGSIEENFLQFLQGTGCPSESWVSRPLPSPKQEPPAVDFRIPGQIAEETSEFLEQQLTSDIIMSDSYLRPAASPRLES

SEQ ID NO: 47079 - protein, 451 aa, Homo sapiens
MESSPIPQSSGNSSTLGRVPQTPGPSTASGVPEVGLRDVASESVALFFMLLLDLTAVAGNAAVMAVIAKTPALRKFVFVFHLCLVDLLAALTLMPLAMLSSSALFDHALFGEVACRLYLFLSVCFVSLAILSVSAINVERYYYVVHPMRYEVRMTLGLVASVLVGVWVKALAMASVPVLGRVSWEEGAPSVPPGCSLQWSHSAYCQLFVVVFAVLYFLLPLLLILVVYCSMFRVARVAAMQHGPLPTWMETPRQRSESLSSRSTMVTSSGAPQTTPHRTFGGGKAAVVLLAVGGQFLLCWLPYFSFHLYVALSAQPISTGQVESVVTWIGYFCFTSNPFFYGCLNRQIRGELSKQFVCFFKPAPEEELRLPSREGSIEENFLQFLQGTGCPSESWVSRPLPSPKQEPPAVDFRIPGQIAEETSEFLEQQLTSDIIMSDSYLRPAASPRLES

SEQ ID NO: 47080 - protein, 451 aa, Homo sapiens; identical to SEQ ID NO: 47079

SEQ ID NO: 47081 - protein, 451 aa, Homo sapiens; identical to SEQ ID NO: 47079

SEQ ID NO: 47082 - protein, 368 aa, Homo sapiens
MANSTGLNASEVAGSLGLILAAVVEVGALLGNGALLVVVLRTPGLRDALYLAHLCVVDLLAAASIMPLGLLAAPPPGLGRVRLGPAPCRAARFLSAALLPACTLGVAALGLARYRLIVHPLRPGSRPPPVLVLTAVWAAAGLLGALSLLGTPPAPPPAPARCSVLAGGLGPFRPLWALLAFALPALLLLGAYGGIFVVARRAALRPPRPARGSRLHSDSLDSRLSILPPLRPRLPGGKAALAPALAVGQFAACWLPYGCACLAPAARAAEAEAAVTWVAYSAFAAHPFLYGLLQRPVRLALGRLSRRALPGPVRACTPQAWHPRALLQCLQRPPEGPAVGPSEAPEQTPELAGGRSPAYQGPPESSLS

SEQ ID NO: 47083 - protein, 419 aa, Homo sapiens
MVFSAVLTAFHTGTSNTTFVVYENTYMNITLPPPFQHPDLSPLLRYSFETMAPTGLSSLTVNSTAVPTTPAAFKSLNLPLQITLSAIMIFILFVSFLGNLVVCLMVYQKAAMRSAINILLASLAFADMLLAVLNMPFALVTILTTRWIFGKFFCRVSAMFFWLFVIEGVAILLIISIDRFLIIVQRQDKLNPYRAKVLIAVSWATSFCVAFPLAVGNPDLQIPSRAPQCVFGYTTNPGYQAYVILISLISFFIPFLVILYSFMGILNTLRHNALRIHSYPEGICLSQASKLGLMSLQRPFQMSIDMGFKTRAFTTILILFAVFIVCWAPFTTYSLVATFSKHFYYQHNFFEISTWLLWLCYLKSALNPLIYYWRIKKFHDACLDMMPKSFKFLPQLPGHTKRRIRPSAVYVCGEHRTVV

SEQ ID NO: 47084 - protein, 419 aa, Homo sapiens; identical to SEQ ID NO: 47083

SEQ ID NO: 47085 - protein, 419 aa, Homo sapiens; identical to SEQ ID NO: 47083

SEQ ID NO: 47086 - protein, 443 aa, Homo sapiens
YCCSVLKCLKNSCISACIFHPTETMVFSAVLTAFHTGTSNTTFVVYENTYMNITLPPPFQHPDLSPLLRYSFETMAPTGLSSLTVNSTAVPTTPAAFKSLNLPLQITLSAIMIFILFVSFLGNLVVCLMVYQKAAMRSAINILLASLAFADMLLAVLNMPFALVTILTTRWIFGKFFCRVSAMFFWLFVIEGVAILLIISIDRFLIIVQRQDKLNPYRAKVLIAVSWATSFCVAFPLAVGNPDLQIPSRAPQCVFGYTTNPGYQAYVILISLISFFIPFLVILYSFMGILNTLRHNALRIHSYPEGICLSQASKLGLMSLQRPFQMSIDMGFKTRAFTTILILFAVFIVCWAPFTTYSLVATFSKHFYYQHNFFEISTWLLWLCYLKSALNPLIYYWRIKKFHDACLDMMPKSFKFLPQLPGHTKRRIRPSAVYVCGEHRTVV

SEQ ID NO: 47087 - protein, 898 aa, Homo sapiens
MVFSVRQCGHVGRTEEVLLTFKIFLVIICLHVVLVTSLEEDTDNSSLSPPPEVETTSLNDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 47088 - protein, 1001 aa, Homo sapiens
MVFSVRQCGHVGRTEEVLLTFKIFLVIICLHVVLVTSLEEDTDNSSLSPPPDEETGACSDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 47089 - protein, 1003 aa, Homo sapiens
MVFSVRQCGHVGRTEEVLLTFKIFLVIICLHVVLVTSLEEDTDNSSLSPPPAKLSVVSFAPSSNGTPEVETTSLNDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 47090 - protein, 987 aa, Homo sapiens
MVFSVRQCGHVGRTEEVLLTFKIFLVIICLHVVLVTSLEEDTDNSSLSPPPEVETTSLNDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 47091 - protein, 1014 aa, Homo sapiens
MVFSVRQCGHVGRTEEVLLTFKIFLVIICLHVVLVTSLEEDTDNSSLSPPPAKLSVVSFAPSSNEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 47092 - protein, 995 aa, Homo sapiens
MVFSVRQCGHVGRTEEVLLTFKIFLVIICLHVVLVTSLEEDTDNSSLSPPPAKLSVVSFAPSSNGTPDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 47093 - protein, 1017 aa, Homo sapiens
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 47094 - protein, 966 aa, Homo sapiens
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSGNASTERNGVSFSVQNGDVCLHDFTGKQHMFNEKEDSCNGKGRMALRRTSKRGSLHFIEQM

SEQ ID NO: 47095 - protein, 993 aa, Homo sapiens
MVFSVRQCGHVGRTEEVLLTFKIFLVIICLHVVLVTSLEEDTDNSSLSPPPDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 47096 - protein, 1001 aa, Homo sapiens
MVFSVRQCGHVGRTEEVLLTFKIFLVIICLHVVLVTSLEEDTDNSSLSPPPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 47097 - protein, 117 aa, Homo sapiens
ILLTMQHINTGIDMLNQLGCVFFAGVKPQRNICNLSSICNDSAFFRGEIMFQYDKESTVPQNQHITNGTLTGVLSLSELKRSELNKTLQTLSETYFIMCATAEAQRHIKLYIHNKTE

SEQ ID NO: 47098 - protein, 337 aa, Homo sapiens
MNSTCIEEQHDLDHYLFPIVYIFVIIVSIPANIGSLCVSFLQAKKESELGIYLFSLSLSDLLYALTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHAVNFEDHSNSGKRTYTMYRITVALTSLNCVADPILYCFVTETGRYDMWNILKFCTGRCNTSQRQRKRILSVSTKDTMELEVLE

SEQ ID NO: 47099 - protein, 540 aa, Homo sapiens
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLYVVDFTFCVAVVSVSYIMIAQTLRKNAQVRKCPPVITVDASRPQPFMGVPVQGGGDPIQCAMPALYRNQNYNKLQHVQTRGYTKSPNQLVTPAASRLQLVSAINLSTAKDSKAVVTCVIIVLSVLVCCLPLGISLVQVVLSSNGSFILYQFELFGFTLIFFKSGLNPFIYSRNSAGLRRKVLWCLQYIGLGFFCCKQKTRLRAMGKGNLEVNRNKSSHHETNSAYMLSPKPQKKFVDQACGPSHSKESMVSPKISAGHQHCGQSSSTPINTRIEPYYSIYNSSPSQEESSPCNLQPVNSFGFANSYIAMHYHTTNDLVQEYDSTSAKQIPVPSV

SEQ ID NO: 47100 - protein, 363 aa, Homo sapiens
MGPGEALLAGLLVMVLAVALLSNALVLLCCAYSAELRTRASGVLLVNLSLGHLLLAALDMPFTLLGVMRGRTPSAPGACQVIGFLDTFLASNAALSVAALSADQWLAVGFPLRYAGRLRPRYAGLLLGCAWGQSLAFSGAALGCSWLGYSSAFASCSLRLPPEPERPRFAAFTATLHAVGFVLPLAVLCLTSLQVHRVARRHCQRMDTVTMKALALLADLHPSVRQRCLIQQKRRRHRATRKIGIAIATFLICFAPYVMTRLAELVPFVTVNAQWGILSKCLTYSKAVADPFTYSLLRRPFRQVLAGMVHRLLKRTPRPASTHDSSLDVAGMVHQLLKRTPRPASTHNGSVDTENDSCLQQTH

SEQ ID NO: 47101 - protein, 336 aa, Homo sapiens
MNNNTTCIQPSMISSMALPIIYILLCIVGVFGNTLSQWIFLTKIGKKTSTHIYLSHLVTANLLVCSAMPFMSIYFLKGFQWEYQSAQCRVVNFLGTLSMHASMFVSLLILSWIAISRYATLMQKDSSQETTSCYEKIFYGHLLKKFRQPNFARKLCIYIWGVVLGIIIPVTVYYSVIEATEGEESLCYNRQMELGAMISQIAGLIGTTFIGFSFLVVLTSYYSFVSHLRKIRTCTSIMEKDLTYSSVKRHLLVIQILLIVCFLPYSIFKPIFYVLHQRDNCQQLNYLIETKNILTCLASARSSTDPIIFLLLDKTFKKTLYNLFTKSNSAHMQSYG

SEQ ID NO: 47102 - protein, 423 aa, Homo sapiens
MVPHLLLLCLLPLVRATEPHEGRADEQSAEAALAVPNASHFFSWNNYTFSDWQNFVGRRRYGAESQNPTVKALLIVAYSFIIVFSLFGNVLVCHVIFKNQRMHSATSLFIVNLAVADIMITLLNTPFTLVRFVNSTWIFGKGMCHVSRFAQYCSLHVSALTLTAIAVDRHQVIMHPLKPRISITKGVIYIAVIWTMATFFSLPHAICQKLFTFKYSEDIVRSLCLPDFPEPADLFWKYLDLATFILLYILPLLIISVAYARVAKKLWLCNMIGDVTTEQYFALRRKKKKTIKMLMLVVVLFALCWFPLNCYVLLLSSKVIRTNNALYFAFHWFAMSSTCYNPFIYCWLNENFRIELKALLSMCQRPPKPQEDRPPSPVPSFRVAWTEKNDGQRAPLANNLLPTSQLQSGKTDLSSVEPIVTMS

SEQ ID NO: 47103 - protein, 396 aa, Homo sapiens
MWNSSDANFSCYHESVLGYRYVAVSWGVVVAVTGTVGNVLTLLALAIQPKLRTRFNLLIANLTLADLLYCTLLQPFSVDTYLHLHWRTGATFCRVFGLLLFASNSVSILTLCLIALGRYLLIAHPKLFPQVFSAKGIVLALVSTWVVGVASFAPLWPIYILVPVVCTCSFDRIRGRPYTTILMGIYFVLGLSSVGIFYCLIHRQVKRAAQALDQYKLRQASIHSNHVARTDEAMPGRFQELDSRLASGGPSEGISSEPVSAATTQTLEGDSSEVGDQINSKRAKQMAEKSPPEASAKAQPIKGARRAPDSSSEFGKVTRMCFAVFLCFALSYIPFLLLNILDARVQAPRVVHMLAANLTWLNGCINPVLYAAMNRQFRQAYGSILKRGPRSFHRLH

SEQ ID NO: 47104 - protein, 396 aa, Homo sapiens; identical to SEQ ID NO: 47103

SEQ ID NO: 47105 - protein, 370 aa, Homo sapiens
MANYSHAADNILQNLSPLTAFLKLTSLGFIIGVSVVGNLLISILLVKDKTLHRAPYYFLLDLCCSDILRSAICFPFVFNSVKNGSTWTYGTLTCKVIAFLGVLSCFHTAFMLFCISVTRYLAIAHHRFYTKRLTFWTCLAVICMVWTLSVAMAFPPVLDVGTYSFIREEDQCTFQHRSFRANDSLGFMLLLALILLATQLVYLKLIFFVHDRRKMKPVQFVAAVSQNWTFHGPGASGQAAANWLAGFGRGPTPPTLLGIRQNANTTGRRRLLVLDEFKMEKRISRMFYIMTFLFLTLWGPYLVACYWRVFARGPVVPGGFLTAAVWMSFAQAGINPFVCIFSNRELRRCFSTTLLYCRKSRLPREPYCVI

SEQ ID NO: 47106 - protein, 370 aa, Homo sapiens; identical to SEQ ID NO: 47105

SEQ ID NO: 47107 - protein, 71 aa, Homo sapiens
MANYSHAADNILQNLSPLTAFLKLTSLGFIIGVSVVGNLLISILLVKDKTLHRAPYYFLLDLCCSDILRSA

SEQ ID NO: 47108 - protein, 370 aa, Homo sapiens; identical to SEQ ID NO: 47105

SEQ ID NO: 47109 - protein, 121 aa, Homo sapiens
MANYSHAADNILQNLSPLTAFLKLTSLGFIIGVSVVGNLLISILLVKDKTLHRAPYYFLLDLCCSDILRSAICFPFVFNSVKNGSTWTYGTLTCKVIAFLGVLSCFHTAFMLFCISVTRYL

SEQ ID NO: 47110 - protein, 370 aa, Homo sapiens; identical to SEQ ID NO: 47105

SEQ ID NO: 47111 - protein, 358 aa, Homo sapiens
MGFNLTLAKLPNNELHGQESHNSGNRSDGPGKNTTLHNEFDTIVLPVLYLIIFVASILLNGLAVWIFFHIRNKTSFIFYLKNIVVADLIMTLTFPFRIVHDAGFGPWYFKFILCRYTSVLFYANMYTSIVFLGLISIDRYLKVVKPFGDSRMYSITFTKVLSVCVWVIMAVLSLPNIILTNGQPTEDNIHDCSKLKSPLGVKWHTAVTYVNSCLFVAVLVILIGCYIAISRYIHKSSRQFISQSSRKRKHNQSIRVVVAVFFTCFLPYHLCRIPFTFSHLDRLLDESAQKILYYCKEITLFLSACNVCLDPIIYFFMCRSFSRRLFKKSNIRTRSESIRSLQSVRRSEVRIYYDYTDV

SEQ ID NO: 47112 - protein, 455 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 47113 - protein, 335 aa, Homo sapiens
MYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 47114 - protein, 455 aa, Homo sapiens; identical to SEQ ID NO: 47112

SEQ ID NO: 47115 - protein, 6306 aa, Homo sapiens
MDIFLVLGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLTVLDDEVPENDEIFLIQLKSVEGGAEINTSRNSIEIIIKKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVLTRNSTDPSPVTADIRPSSGVLHFAQGQMLATIPLTVVDDDLPEEAEAYLLQILPHTIRGGAEVSEPAELLFYIQDSDDVYGLITFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDRVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNGIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGQDMSALYCWNSERNQFSFVLEVPSAYDVASVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 47116 - protein, 2306 aa, Homo sapiens
VDVFMFLGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLTVLDDEVPENDEIFLIQLKSVEGGAEINTSRNSIEIIIKKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVLTRNSTDPSPVTADIRPSSGVLHFAQGQMLATIPLTVVDDDLPEEAEAYLLQILPHTIRGGAEVSEPAELLFYIQDSDDVYGLITFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDRVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGMSSYPSATN

SEQ ID NO: 47117 - protein, 6306 aa, Homo sapiens
MSVFLGPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLTVLDDEVPENDEIFLIQLKSVEGGAEINTSRNSIEIIIKKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVLTRNSTDPSPVTADIRPSSGVLHFAQGQMLATIPLTVVDDDLPEEAEAYLLQILPHTIRGGAEVSEPAELLFYIQDSDDVYGLITFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDRVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNGIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGQDMSALYCWNSERNQFSFVLEVPSAYDVASVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 47118 - protein, 1395 aa, Homo sapiens
MTGAEIESGAQVKPEKKPGEEVVGGAEIENDVPLVVRPKVRTQAQIMPGARPKNKSKVMPGASTKVETSAVGGARPKSKAKAIPVSRFKEEAQMWAQPRFGAERLSKTERNSQTNIIASPLVSTDSVLVAKTKYLSEDRELVNTDTESFPRRKAHYQAGFQPSFRSKEETNMGSWCCPRPTSKQEASPNSDFKWVDKSVSSLFWSGDEVTAKFHPGNRVKDSNRSMHMANQEANTMSRSQTNQELYIASSSGSEDESVKTPWFWARDKTNTWSGPREDPNSRSRFRSKKEVYVESSSGSEHEDHLESWFGAGKEAKFRSKMRAGKEANNRARHRAKREACIDFMPGSIDVIKKESCFWPEENANTFSRPMIKKEARARAMTKEEAKTKARARAKQEARSEEEALIGTWFWATDESSMADEASIESSLQVEDESIIGSWFWTEEEASMGTGASSKSRPRTDGERIGDSLFGAREKTSMKTGAEATSESILAADDEQVIIGSWFWAGEEVNQEAEEETIFGSWFWVIDAASVESGVGVSCESRTRSEEEEVIGPWFWSGEQVDIEAGIGEEARPGAEEETIFGSWFWAENQTYMDCRAETSCDTMQGAEEEEPIIGSWFWTRVEACVEGDVNSKSSLEDKEEAMIPCFGAKEEVSMKHGTGVRCRFMAGAEETNNKSCFWAEKEPCMYPAGGGSWKSRPEEEEDIVNSWFWSRKYTKPEAIIGSWLWATEESNIDGTGEKAKLLTEEETIINSWFWKEDEAISEATDREESRPEAEEGDIIGSWFWAGEEDRLEPAAETREEDRLAAEKEGIVGSWFGAREETIRREAGSCSKSSPKAEEEEVIIGSWFWEEEASPEAVAGVGFESKPGTEEEEITVGSWFWPEEEASIQAGSQAVEEMESETEEETIFGSWFWDGKEVSEEAGPCCVSKPEDDEEMIVESWFWSRDKAIKETGTVATCESKPENEEGAIVGSWFEAEDEVDNRTDNGSNCGSRTLADEDEAIVGSWFWAGDEAHFESNPSPVFRAICRSTCSVEQEPDPSRRPQSWEEVTVQFKPGPWGRVGFPSISPFRFPKEAASLFCEMFGGKPRNMVLSPEGEDQESLLQPDQPSPEFPFQYDPSYRSVQEIREHLRAKESTEPESSSCNCIQCELKIGSEEFEELLLLMEKIRDPFIHEISKIAMGMRSASQFTRDFIRDSGVVSLIETLLNYPSSRVRTSFLENMIRMAPPYPNLNIIQTYICKVCEETLAYSVDSPEQLSGIRMIRHLTTTTDYHTLVANYMSGFLSLLATGNAKTRFHVLKMLLNLSENLFMTKELLSAEAVSEFIGLFNREETNDNIQIVLAIFENIGNNIKKETVFSDDDFNIEPLISAFHKVEKFAKELQGKTDNQNDPEGDQEN

SEQ ID NO: 47119 - protein, 1395 aa, Homo sapiens; identical to SEQ ID NO: 47118

SEQ ID NO: 47120 - protein, 1395 aa, Homo sapiens; identical to SEQ ID NO: 47118

SEQ ID NO: 47121 - protein, 1395 aa, Homo sapiens; identical to SEQ ID NO: 47118

SEQ ID NO: 47122 - protein, 563 aa, Homo sapiens
MDFGSLETVVANSAFIAARGSFDGSSSQPSRDKKYLAKLKLPPLSKCESLRDSLSLEFESVCLEQPIGKKLFQQFLQSAEKHLPALELWKDIEDYDTADNDLQPQKAQTILAQYLDPQAKLFCSFLDEGIVAKFKEGPVEIQDGLFQPLLQATLAHLGQAPFQEYLGSLYFLRFLQWKWLEAQPMGEDWFLDFRVLGKGGFGEVSACQMKATGKLYACKKLNKKRLKKRKGYQGAMVEKKILMKVHSRFIVSLAYAFETKADLCLVMTIMNGGDIRYHIYNVNEENPGFPEPRALFYTAQIICGLEHLHQRRIVYRDLKPENVLLDNDGNVRISDLGLAVELLDGQSKTKGYAGTPGFMAPELLQGEEYDFSVDYFALGVTLYEMIAARGPFRARGEKVENKELKHRIISEPVKYPDKFSQASKDFCEALLEKDPEKRLGFRDETCDKLRAHPLFKDLNWRQLEAGMLMPPFIPDSKTVYAKDIQDVGAFSTVKGVAFDKTDTEFFQEFATGNCPIPWQEEMIETGIFGELNVWRSDGQMPDDMKGISGGSSSSSKSGMCLVS

SEQ ID NO: 47123 - protein, 94 aa, Homo sapiens
MIAARGPFRARGEKVENKELKHRIISEPVKYPDKFSQASKDFCEALLEKDPEKRLGFRDETCDKLRAHPLFKDLNWRQLEAGMLMPPFIPDSKT

SEQ ID NO: 47124 - protein, 75 aa, Homo sapiens
MELENIVANTVLLKAREGGGGKRKGKSKKWKEILKFPHISQCEDLRRTIGELSGSLISWSSSTKEHGRPTEIKMR

SEQ ID NO: 47125 - protein, 485 aa, Homo sapiens [sequence omitted]

SEQ ID NO: 47126 - protein, 590 aa, Homo sapiens
MELENIVANTVLLKAREGGGGKRKGKSKKWKEILKFPHISQCEDLRRTIDRDYCSLCDKQPIGRLLFRQFCETRPGLECYIQFLDSVAEYEVTPDEKLGEKGKEIMTKYLTPKSPVFIAQVGQDLVSQTEEKLLQKPCKELFSACAQSVHEYLRGEPFHEYLDSMFFDRFLQWKWLERQPVTKNTFRQYRVLGKGGFGEVCACQVRATGKMYACKRLEKKRIKKRKGESMALNEKQILEKVNSQFVVNLAYAYETKDALCLVLTIMNGGDLKFHIYNMGNPGFEEERALFYAAEILCGLEDLHRENTVYRDLKPENILLDDYGHIRISDLGLAVKIPEGDLIRGRVGTVGYMAPEVLNNQRYGLSPDYWGLGCLIYEMIEGQSPFRGRKEKVKREEVDRRVLETEEVYSHKFSEEAKSICKMLLTKDAKQRLGCQEEGAAEVKRHPFFRNMNFKRLEAGMLDPPFVPDPRAVYCKDVLDIEQFSTVKGVNLDHTDDDFYSKFSTGSVSIPWQNEMIETECFKELNVFGPNGTLPPDLNRNHPPEPPKKGLLQRLFKRQHQNNSKSSPSSKTSFNHHINSNHVSSNSTGSS

SEQ ID NO: 47127 - protein, 399 aa, Homo sapiens
MTKYLTPKSPVFIAQVGQDLVSQTEEKLLQKPCKELFSACAQSVHEYLRGEPFHEYLDSMFFDRFLQWKWLERQPVTKNTFRQYRVLGKGGFGEVCACQVRATGKMYACKRLEKKRIKKRKGESMALNEKQILEKVNSQFVVNLAYAYETKDALCLVLTIMNGGDLKFHIYNMGNPGFEEGAAEVKRHPFFRNMNFKRLEAGMLDPPFVPDPRAVYCKDVLDIEQFSTVKGVNLDHTDDDFYSKFSTGSVSIPWQNEMIETECFKELNVFGPNGTLPPDLNRNHPPEPPKKGLLQRLFKRQHQNNSKSSPSSKSTVEPAQTLLLRSGSSGAPALVGLPGETPGAGEGGRPSRRRRTSRFLKEISTQVCFPRRPRPGWIGFVFGEHCNRNPIGYDNLHVF

SEQ ID NO: 47128 - protein, 576 aa, Homo sapiens
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFYQKFATGSVPIPWQNEMVETECFQELNVFGLDGSVPPDLDWKGQPPAPPKKGLLQRLFSRQDCCGNCSDSEEELPTRL

SEQ ID NO: 47129 - protein, 560 aa, Homo sapiens
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFYQKFATGSVPIPWQNEMVETECFQELNVFGLDGSVPPDLDWKGQPPAPPKKGLLQRLFSRQR

SEQ ID NO: 47130 - protein, 589 aa, Homo sapiens
MELENIVANTVLLKAREGGGGNRKGKSKKWRQMLQFPHISQCEELRLSLERDYHSLCERQPIGRLLFREFCATRPELSRCVAFLDGVAEYEVTPDDKRKACGRQLTQNFLSHTGPDLIPEVPRQLVTNCTQRLEQGPCKDLFQELTRLTHEYLSVAPFADYLDSIYFNRFLQWKWLERQPVTKNTFRQYRVLGKGGFGEVCACQVRATGKMYACKKLEKKRIKKRKGEAMALNEKQILEKVNSRFVVSLAYAYETKDALCLVLTLMNGGDLKFHIYHMGQAGFPEARAVFYAAEICCGLEDLHRERIVYRDLKPENILLDDHGHIRISDLGLAVHVPEGQTIKGRVGTVGYMAPEVVKNERYTFSPDWWALGCLLYEMIAGQSPFQQRKKKIKREEVERLVKEVPEEYSERFSPQARSLCSQLLCKDPAERLGCRGGSAREVKEHPLFKKLNFKRLGAGMLEPPFKPDPQAIYCKDVLDIEQFSTVKGVELEPTDQDFYQKFATGSVPIPWQNEMVETECFQELNVFGLDGSVPPDLDWKGQPPAPPKKGLLQRLFSRQRIAVETAATARKSSPPASSPQPEAPTSSWR

SEQ ID NO: 47131 - protein, 553 aa, Homo sapiens
MVDMGALDNLIANTAYLQARKPSDCDSKELQRRRRSLALPGLQGCAELRQKLSLNFHSLCEQQPIGRRLFRDFLATVPTFRKAATFLEDVQNWELAEEGPTKDSALQGLVATCASAPAPGNPQPFLSQAVATKCQAATTEEERVAAVTLAKAEAMAFLQEQPFKDFVTSAFYDKFLQWKLFEMQPVSDKYFTEFRVLGKGGFGEVCAVQVKNTGKMYACKKLDKKRLKKKGGEKMALLEKEILEKVSSPFIVSLAYAFESKTHLCLVMSLMNGGDLKFHIYNVGTRGLDMSRVIFYSAQIACGMLHLHELGIVYRDMKPENVLLDDLGNCRLSDLGLAVEMKGGKPITQRAGTNGYMAPEILMEKVSYSYPVDWFAMGCSIYEMVAGRTPFKDYKEKVSKEDLKQRTLQDEVKFQHDNFTEEAKDICRLFLAKKPEQRLGSREKSDDPRKHHFFKTINFPRLEAGLIEPPFVPDPSVVYAKDIAEIDDFSEVRGVEFDDKDKQFFKNFATGAVPIAWQEEIIETGLFEELNDPNRPTGCEEGNSSKSGVCLLL

SEQ ID NO: 47132 - protein, 761 aa, Homo sapiens
MSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 47133 - protein, 177 aa, Homo sapiens
MSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDDLTGHRSWATPDINPHPNRATGTSALSAATLPGSQVPWCPPLSSP

SEQ ID NO: 47134 - protein, 770 aa, Homo sapiens
MSRKGPRAEVCADCSAPDPGWASISRGVLVCDECCSVHRSLGRHISIVKHLRHSAWPPTLLQMVHTLASNGANSIWEHSLLDPAQVQSGRRKANPQDKVHPIKSEFIRAKYQMLAFVHKLPCRDDDGVTAKDLSKQLHSSVRTGNLETCLRLLSLGAQANFFHPEKGTTPLHVAAKAGQTLQAELLVVYGADPGSPDVNGRTPIDYARQAGHHELAERLVECQYELTDRLAFYLCGRKPDHKNGHYIIPQMADRSRQKCMSQSLDLSELAKAAKKKLQALSNRLFEELAMDVYDEVDRRENDAVWLATQNHSTLVTERSAVPFLPVNPEYSATRNQGRQKLARFNAREFATLIIDILSEAKRRQQGKSLSSPTDNLELSLRSQSDLDDQHDYDSVASDEDTDQEPLRSTGATRSNRARSMDSSDLSDGAVTLQEYLELKKALATSEAKVQQLMKVNSSLSDELRRLQREIHKLQAENLQLRQPPGPVPTPPLPSERAEHTPMAPGGSTHRRDRQAFSMYEPGSALKPFGGPPGDELTTRLQPFHSTELEDDAIYSVHVPAGLYRIRKGVSASAVPFTPSSPLLSCSQEGSRHTSKLSRHGSGADSDYENTQSGDPLLGLEGKRFLELGKEEDFHPELESLDGDLDPGLPSTEDVILKTEQVTKNIQELLRAAQEFKHDSFVPCSEKIHLAVTEMASLFPKRPALEPVRSSLRLLNASAYRLQSECRKTVPPEPGAPVDFQLLTQQVIQCAYDIAKAAKQLVTITTREKKQ

SEQ ID NO: 47135 - protein, 403 aa, Homo sapiens
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 47136 - protein, 404 aa, Homo sapiens
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTEMVTHPRSLESFGAF

SEQ ID NO: 47137 - protein, 429 aa, Homo sapiens
MNPPWSVAWGQEGFRAGTPGSRYLPRMFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 47138 - protein, 252 aa, Homo sapiens
MFVASERKMRAHQVLTFLLLFVITSVASENASTSRGCGLDLLPQYVSLCDLDAIWGIVVEAVAGAGALITLLLMLILLVRLPFFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 47139 - protein, 162 aa, Homo sapiens
MAIHKALVMCLGLPLFLFPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVSELTQRGQANTNQVFLRL

SEQ ID NO: 47140 - protein, 486 aa, Homo sapiens
MRGRGSQQQQPTRRQGQKLPSPSPAGKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 47141 - protein, 441 aa, Homo sapiens
MAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 47142 - protein, 442 aa, Homo sapiens
MAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQAQSPQSKTRW

SEQ ID NO: 47143 - protein, 453 aa, Homo sapiens
MGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 47144 - protein, 345 aa, Homo sapiens
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRGCVSFSWTTILCIAIGCSLLQIIIATEYVTLIMTRGMMFVNMTPCQLNVDFVVLLVYVLFLMALTFFVSKATFCGPCENWKQHGRLIFITVLFSIIIWVVWISMLLRGNPQFQRQPQWDDPVVCIALVTNAWVFLLLYIVPELCILYRSCRQECPLQGNACPVTAYQHSFQVENQELSRARDSDGAEEDVALTSYGTPIQPQTVDPTQECFIPQAKLSPQQDAGGV

SEQ ID NO: 47145 - protein, 300 aa, Homo sapiens
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRGCVSFSWTTILCIAIGCSLLQIIIATEYVTLIMTRGMMFVNMTPCQLNVDFVVLLVYVLFLMALTFFVSKATFCGPCENWKQHGRLIFITVLFSIIIWVVWISMLLRGNPQFQRQPQWDDPVVCIALVTNAWVFLLLYIVPELCILYRSCRQECPLQGNACPVTAYQHSFQVENQELSRDC

SEQ ID NO: 47146 - protein, 120 aa, Homo sapiens
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRG

SEQ ID NO: 47147 - protein, 103 aa, Homo sapiens
METVQELIPLAKEMMAQKRKGKMVKLYVLGSVLALFGVVLGLMETVCSPFTAARRLRDQEAAVAELQAALERQALQKQALQEKGKQQDTVLGGRALSNRQHAS

SEQ ID NO: 47148 - protein, 499 aa, Homo sapiens
MELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 47149 - protein, 637 aa, Homo sapiens
MDPGSGGGGGGGGGGGSSSGSSSSDSAPDCWDQADMEAPGPGPCGGGGSLAAAAEAQRENLSAAFSRQLNVNAKPFVPNVHAAEFVPSFLRGPAAPPPPVGGAANNHGAGSGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 47150 - protein, 636 aa, Homo sapiens
MDPGSGGGGGGGGGGGSSSGSSSSDSAPDCWDQADMEAPGPGPCGGGGSLAAAAEAQRENLSAAFSRQLNVNAKPFVPNVHAAEFVPSFLRGPAAPPPPVGGAANNHGAGSGAGGRAAPVESSQEEQSLCEGSNSAVSMELSEPIENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 47151 - protein, 628 aa, Homo sapiens
MDSGSSSSDSAPDCWDQVDMESPGSAPSGDGVSSAVAEAQREPLSSAFSRKLNVNAKPFVPNVHAAEFVPSFLRGPTQPPTLPAGSGSNDETCTGAGYPQGKRMGRGAPVEPSREEPLVSLEGSNSAVTMELSEPVVENGEVEMALEESWEHSKEVSEAEPGGGSSGDSGPPEESGQEMMEEKEEIRKSKSVIVPSGAPKKEHVNVVFIGHVDAGKSTIGGQIMFLTGMVDKRTLEKYEREAKEKNRETWYLSWALDTNQEERDKGKTVEVGRAYFETERKHFTILDAPGHKSFVPNMIGGASQADLAVLVISARKGEFETGFEKGGQTREHAMLAKTAGVKHLIVLINKMDDPTVNWSIERYEECKEKLVPFLKKVGFSPKKDIHFMPCSGLTGANIKEQSDFCPWYTGLPFIPYLDNLPNFNRSIDGPIRLPIVDKYKDMGTVVLGKLESGSIFKGQQLVMMPNKHNVEVLGILSDDTETDFVAPGENLKIRLKGIEEEEILPGFILCDPSNLCHSGRTFDVQIVIIEHKSIICPGYNAVLHIHTCIEEVEITALISLVDKKSGEKSKTRPRFVKQDQVCIARLRTAGTICLETFKDFPQMGRFTLRDEGKTIAIGKVLKLVPEKD

SEQ ID NO: 47152 - protein, 545 aa, Homo sapiens
MDSGSNDETCTGAGYPQGKRMGRGAPVEPSREEPLVSLEGSNSAVTMELSEPVVENGEVEMALEESWEHSKEVSEAEPGGGSSGDSGPPEESGQEMMEEKEEIRKSKSVIVPSGAPKKEHVNVVFIGHVDAGKSTIGGQIMFLTGMVDKRTLEKYEREAKEKNRETWYLSWALDTNQEERDKGKTVEVGRAYFETERKHFTILDAPGHKSFVPNMIGGASQADLAVLVISARKGEFETGFEKGGQTREHAMLAKTAGVKHLIVLINKMDDPTVNWSIERYEECKEKLVPFLKKVGFSPKKDIHFMPCSGLTGANIKEQSDFCPWYTGLPFIPYLDNLPNFNRSIDGPIRLPIVDKYKDMGTVVLGKLESGSIFKGQQLVMMPNKHNVEVLGILSDDTETDFVAPGENLKIRLKGIEEEEILPGFILCDPSNLCHSGRTFDVQIVIIEHKSIICPGYNAVLHIHTCIEEVEITALISLVDKKSGEKSKTRPRFVKQDQVCIARLRTAGTICLETFKDFPQMGRFTLRDEGKTIAIGKVLKLVPEKD

SEQ ID NO: 47153 - protein, 454 aa, Homo sapiens
MTKREAEELIEIEIDGTEKAECTEESIVEQTYAPAECVSQAIDINEPIGNLKKLLEPRLQCSLDAHEICLQDIQLDPERSLFDQGVKTDGTVQLSVQVISYQGIEPKLNILEIVKPADTVEVVIDPDAHHAESEAHLVEEAQVITLDGTKHITTISDETSEQVTRWAAALEGYRKEQERLGIPYDPIQWSTDQVLHWVVWVMKEFSMTDIDLTTLNISGRELCSLNQEDFFQRVPRGEILWSHLELLRKYVLASQEQQMNEIVTIDQPVQIIPASVQSATPTTIKVINSSAKAAKVQRAPRISGEDRSSPGNRTGNNGQIQLWQFLLELLTDKDARDCISWVGDEGEFKLNQPELVAQKWGQRKNKPTMNYEKLSRALRYYYDGDMICKVQGKRFVYKFVCDLKTLIGYSAAELNRLVTECEQKKLAKMQLHGIAQPVTAVALATASLQTEKDN

SEQ ID NO: 47154 - protein, 454 aa, Homo sapiens; identical to SEQ ID NO: 47153

SEQ ID NO: 47155 - protein, 395 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 47156 - protein, 348 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEVRSLLPGVLCRSHPK

SEQ ID NO: 47157 - protein, 383 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 47158 - protein, 348 aa, Homo sapiens; identical to SEQ ID NO: 47156

SEQ ID NO: 47159 - protein, 360 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEVRSLLPGVLCRSHPK

SEQ ID NO: 47160 - protein, 89 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEV

SEQ ID NO: 47161 - protein, 89 aa, Homo sapiens; identical to SEQ ID NO: 47160

SEQ ID NO: 47162 - protein, 117 aa, Homo sapiens
MKFVYKEEHPFEKRRSEGEKIRKKYPDRVPVIVEKAPKARIGDLDKKKYLVPSDLTVGQFYFLIRKRIHLRAEDALFFFVNNVIPPTSATMGQLYQEHHEEDFFLYIAYSDESVYGL

SEQ ID NO: 47163 - protein, 117 aa, Homo sapiens
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 47164 - protein, 146 aa, Homo sapiens
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEVMVLVAQYWMPSSAVWHPLALVLDALITHLRSGAEGVIYPDPLTYGSVRL

SEQ ID NO: 47165 - protein, 146 aa, Homo sapiens; identical to SEQ ID NO: 47164

SEQ ID NO: 47166 - protein, 70 aa, Homo sapiens
MKFQYKEDHPFEYRKKEGEKIRKKYPDRVPVIVEKAPKARVPDLDKRKYLVPSDLTVGQFYFLIRKRIHL

SEQ ID NO: 47167 - protein, 117 aa, Homo sapiens; identical to SEQ ID NO: 47163

SEQ ID NO: 47168 - protein, 117 aa, Homo sapiens
MKWMFKEDHSLEHRCVESAKIRAKYPDRVPVIVEKVSGSQIVDIDKRKYLVPSDITVAQFMWIIRKRIQLPSEKAIFLFVDKTVPQSSLTMGQLYEKEKDEDGFLYVAYSGENTFGF

SEQ ID NO: 47169 - protein, 447 aa, Homo sapiens
MPVLYDRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 47170 - protein, 434 aa, Homo sapiens
MFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 47171 - protein, 207 aa, Homo sapiens
MNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDDGVVLYRPGWSATA

SEQ ID NO: 47172 - protein, 434 aa, Homo sapiens; identical to SEQ ID NO: 47170

SEQ ID NO: 47173 - protein, 434 aa, Homo sapiens; identical to SEQ ID NO: 47170

SEQ ID NO: 47174 - protein, 458 aa, Homo sapiens
MATESPATRRVQVAEHPRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 47175 - protein, 423 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLNARRDSPVPRLSGELYGRATAWNMLDSHLYRHFNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 47176 - protein, 423 aa, Homo sapiens; identical to SEQ ID NO: 47175

SEQ ID NO: 47177 - protein, 423 aa, Homo sapiens; identical to SEQ ID NO: 47175

SEQ ID NO: 47178 - protein, 423 aa, Homo sapiens; identical to SEQ ID NO: 47175

SEQ ID NO: 47179 - protein, 423 aa, Homo sapiens; identical to SEQ ID NO: 47175

SEQ ID NO: 47180 - protein, 423 aa, Homo sapiens; identical to SEQ ID NO: 47175

SEQ ID NO: 47181 - protein, 85 aa, Homo sapiens
MLPPQKKPWESMAKGLVLGALFTSFLLLVYSYAVPPLHAGLASTTPEAAASCSPPALEPEAVIRANGSAGECQPRRNIVFLKTHK

SEQ ID NO: 47182 - protein, 170 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLF

SEQ ID NO: 47183 - protein, 149 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEV

SEQ ID NO: 47184 - protein, 99 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFG

SEQ ID NO: 47185 - protein, 103 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHR

SEQ ID NO: 47186 - protein, 199 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQD

SEQ ID NO: 47187 - protein, 279 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLN

SEQ ID NO: 47188 - protein, 423 aa, Homo sapiens; identical to SEQ ID NO: 47175

SEQ ID NO: 47189 - protein, 143 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMR

SEQ ID NO: 47190 - protein, 76 aa, Homo sapiens
MLPPQKKPWESMAKGLVLGALFTSFLLLVYSYAVPPLHAGLASTTPEAAASCSPPALEPEAVIRANGSAGECQPRR

SEQ ID NO: 47191 - protein, 95 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNIL

SEQ ID NO: 47192 - protein, 71 aa, Homo sapiens
MLPPQKKPWESMAKGLVLGALFTSFLLLVYSYAVPPLHAGLASTTPEAAASCSPPALEPEAVIRANGSAGE

SEQ ID NO: 47193 - protein, 242 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEV

SEQ ID NO: 47194 - protein, 100 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQ

SEQ ID NO: 47195 - protein, 398 aa, Homo sapiens
MMSMLGGLQRYFRVILLLLLALTLLLLAGFLHSDLELDTPLFGGQAEGPPVTNIMFLKTHKTASSTVLNILYRFAETHNLSVALPAGSRVHLGYPWLFLARYVEGVGSQQRFNIMCNHLRFNLPQVQKVMPNDTFYFSILRNPVFQLESSFIYYKTYAPAFRGAPSLDAFLASPRTFYNDSRHLRNVYAKNNMWFDFGFDPNAQCEEGYVRARIAEVERRFRLVLIAEHLDESLVLLRRRLRWALDDVVAFRLNSRSARSVARLSPETRERARSWCALDWRLYEHFNRTLWAQLRAELGPRRLRGEVERLRARRRELASLCLQDGGALKNHTQIRDPRLRPYQSGKADILGYNLRPGLDNQTLGVCQRLVMPELQYMARLYALQFPEKPLKNIPFLGA

SEQ ID NO: 47196 - protein, 431 aa, Homo sapiens
MPPILQRLQQATKMMSRRKILLLVLGCSTVSLLIHQGAQLSWYPKLFPLSCPPLRNSPPRPKHMTVAFLKTHKTAGTTVQNILFRFAERHNLTVALPHPSCEHQFCYPRNFSAHFVHPATRPPHVLASHLRFDRAELERLMPPSTVYVTILREPAAMFESLFSYYNQYCPAFRRVPNASLEAFLRAPEAYYRAGEHFAMFAHNTLAYDLGGDNERSPRDDAAYLAGLIRQVEEVFSLVMIAEYFDESLVLLRRLLAWDLDDVLYAKLNARAASSRLAAIPAALARAARTWNALDAGLYDHFNATFWRHVARAGRACVEREARELREARQRLLRRCFGDEPLLRPAAQIRTKQLQPWQPSRKVDIMGYDLPGGGAGPATEACLKLAMPEVQYSNYLLRKQKRRGGARARPEPVLDNPPPRPIRVLPRGPQGP

SEQ ID NO: 47197 - protein, 431 aa, Homo sapiens; identical to SEQ ID NO: 47196

SEQ ID NO: 47198 - protein, 486 aa, Homo sapiens
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKLFQASRVKGYRPQGGGTQLPFHILCHHMRFNLKEVLQVMPSDSFFFSIVRDPAALARSAFSYYKSTSSAFRKSPSLAAFLANPRGFYRPGARGDHYARNLLWFDFGLPFPPEKRAKRGNIHPPRDPNPPQLQVLPSGAGPRAQTLNPNALIHPVSTVTDHRSQISSPASFDLGSSSFIQWGLAWLDSVFDLVMVAEYFDESLVLLADALCWGLDDVVGFMHNAQAGHKQGLSTVSNSGLTAEDRQLTARARAWNNLDWALYVHFNRSLWARIEKYGQGRLQTAVAELRARREALAKHCLVGGEASDPKYITDRRFRPFQFGSAKVLGYILRSGLSPQDQEECERLATPELQYKDKLDAKQFPPTVSLPLKTSRPLSP

SEQ ID NO: 47199 - protein, 486 aa, Homo sapiens; identical to SEQ ID NO: 47198

SEQ ID NO: 47200 - protein, 424 aa, Homo sapiens
MTPRSPTSAFRSCTAVSSCLCPSSWPWLHLSVTSPFPVPHGPSLSCQDAAALGTSEPGGGSGSLHDHWLCTPALGRALPEEVLQVMPSDSFFFSIVRDPAALARSAFSYYKSTSSAFRKSPSLAAFLANPRGFYRPGARGDHYARNLLWFDFGLPFPPEKRAKRGNIHPPRDPNPPQLQVLPSGAGPRAQTLNPNALIHPVSTVTDHRSQISSPASFDLGSSSFIQWGLAWLDSVFDLVMVAEYFDESLVLLADALCWGLDDVVGFMHNAQAGHKQGLSTVSNSGLTAEDRQLTARARAWNNLDWALYVHFNRSLWARIEKYGQGRLQTAVAELRARREALAKHCLVGGEASDPKYITDRRFRPFQFGSAKVLGYILRSGLSPQDQEECERLATPELQYKDKLDAKQFPPTVSLPLKTSRPLSP

SEQ ID NO: 47201 - protein, 546 aa, Homo sapiens
MPGFLVRILPLLLVLLLLGPTRGLRNATQRMFEIDYSRDSFLKDGQPFRYISGSIHYSRVPRFYWKDRLLKMKMAGLNAIQTLPGSCGQVVGSPSAQDEASPLSEWRASYNSAGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVCSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 47202 - protein, 647 aa, Homo sapiens
MFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVCSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 47203 - protein, 677 aa, Homo sapiens
MPGFLVRILPLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVCSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 47204 - protein, 725 aa, Homo sapiens
MPGFLVRILPLLLVLLLLGPTRGLRSRFLPWAFHLPRQAPKSQLPLHKRGTKTAPNEHASSNRSGRRRRRQQWNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVCSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 47205 - protein, 685 aa, Homo sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 47206 - protein, 662 aa, Homo sapiens
MAEWLLSASWQRRAKAMTAAAGSAGRAAVPLLLCALLAPGGAYVLDDSDGLGREFDGIGAVSGGGPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 47207 - protein, 659 aa, Homo sapiens
MLGKSHGRATHGPLPLADLGIHLPCVKVLHQVTPEEKPAATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 47208 - protein, 474 aa, Homo sapiens
MLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 47209 - protein, 589 aa, Homo sapiens
MGFMVADLWATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKVAGRRKKT

SEQ ID NO: 47210 - protein, 123 aa, Homo sapiens
MARGSALLLASLLLAAALSASAGLWSPAKEKRGWTLNSAGYLLGPHAVGNHRSFSDKNGLTSKRELRPEDDMKPGSFDRSIPENNIMRTIIEFLSFLHLKEAGALDRLLDLPAAASSEDIERS

SEQ ID NO: 47211 - protein, 349 aa, Homo sapiens
MELAVGNLSEGNASWPEPPAPEPGPLFGIGVENFVTLVVFGLIFALGVLGNSLVITVLARSKPGKPRSTTNLFILNLSIADLAYLLFCIPFQATVYALPTWVLGAFICKFIHYFFTVSMLVSIFTLAAMSVDRYVAIVHSRRSSSLRVSRNALLGVGCIWALSIAMASPVAYHQGLFHPRASNQTFCWEQWPDPRHKKAYVVCTFVFGYLLPLLLICFCYAKVLNHLHKKLKNMSKKSEASKKKTAQTVLVVVVVFGISWLPHHIIHLWAEFGVFPLTPASFLFRITAHCLAYSNSSVNPIIYAFLSENFRKAYKQVFKCHIRKDSHLSDTKESKSRIDTPPSTNCTHV

SEQ ID NO: 47212 - protein, 387 aa, Homo sapiens
MNVSGCPGAGNASQAGGGGGWHPEAVIVPLLFALIFLVGTVGNTLVLAVLLRGGQAVSTTNLFILNLGVADLCFILCCVPFQATIYTLDGWVFGSLLCKAVHFLIFLTMHASSFTLAAVSLDRYLAIRYPLHSRELRTPRNALAAIGLIWGLSLLFSGPYLSYYRQSQLANLTVCHPAWSAPRRRAMDICTFVFSYLLPVLVLGLTYARTLRYLWRAVDPVAAGSGARRAKRKVTRMILIVAALFCLCWMPHHALILCVWFGQFPLTRATYALRILSHLVSYANSCVNPIVYALVSKHFRKGFRTICAGLLGRAPGRASGRVCAAARGTHSGSVLERESSDLLHMSEAAGALRPCPGASQPCILEPCPGPSWQGPKAGDSILTVDVA

SEQ ID NO: 47213 - protein, 368 aa, Homo sapiens
MADAQNISLDSPGSVGAVAVPVVFALIFLLGTVGNGLVLAVLLQPGPSAWQEPGSTTDLFILNLAVADLCFILCCVPFQATIYTLDAWLFGALVCKAVHLLIYLTMYASSFTLAAVSVDRYLAVRHPLRSRALRTPRNARAAVGLVWLLAALFSAPYLSYYGTVRYGALELCVPAWEDARRRALDVATFAAGYLLPVAVVSLAYGRTLRFLWAAVGPAGAAAAEARRRATGRAGRAMLAVAALYALCWGPHHALILCFWYGRFAFSPATYACRLASHCLAYANSCLNPLVYALASRHFRARFRRLWPCGRRRRHRARRALRRVRPASSGPPGCPGDARPSGRLLAGGGQGPEPREGPVHGGEAARGPE

SEQ ID NO: 47214 - protein, 652 aa, Homo sapiens
MGNLQSEPSAGGGSRKVQPSDRAPDSRRTSLVEPEMTSQAMRLTRGLGVWFPGSATPPGLMVPREPQASPSTLPLTLERPSPVMPPPEEAAAVSAPPPAPAGTLLPGPSKWQKPAGTPVPRIRRLLEASHRGQGDPPSLRPLKPPPPPRQLSVKDTVPRAPSQFPPPLETWKPPPPLPSERQPADRRITPALATPASPPTESQAGPRNQGQTAGRARGGAPPHAGEGEMAQPADSESGLSLLCKITFKSRPSLAPPAASSSLAAKASLGGGGGGGLFAASGAISYAEVLKQGPLPPGAARPLGEVSRGAQEAEGGDGDGEGCSGPPSAPASQARALPPPPYTTFPGSKPKFDWVSAPDGPERHFRFNGAGGGIGAPRRRAAALSGPWGSPPPPPEQIHSAPGPRRPAPALLAPPTFIFPAPTNGEPMRPGPPGLQELPPLPPPTPPPTLQPPALQPTPLPVAPPLTPGLGHKESALAPTAAPALPPALAADQAPAPSPAPAPTVAEPSPPVSAPAPAAAPIKTRTRRNKGSRAARGATRKDGLHGDGPRERATATVPDSSGGGGGGSGASQTGAANTRAARHWLPFQVLNSCPCKCYCHHQPRHRRLPRNVSAWLSTSTNHLGEPPWVATIKLSGSLVAKLEHYDLQATHSN

SEQ ID NO: 47215 - protein, 224 aa, Homo sapiens
MGNLQSEPSAGGGSRKVQPSDRAPDSRRTSLVEPEMTSQAMRLTRGLGVWFPGSATPPGLMVPREPQASPSTLPLTLERPSPVMPPPEEAAAVSAPPPAPAGTLLPGPSKWQKPAGTPVPRIRRLLEASHRGQGDPPSLRPLKPPPPPRQLSVKDTVPRAPSQFPPPLETWKPPPPLPSERQPADRRITPALATPACVRARTRGCAHQDPHAQEQGFPCSPGRD

SEQ ID NO: 47216 - protein, 697 aa, Homo sapiens
MARLVAVCRDGEEEFPFERRQIPLYIDDTLTMVMEFPDNVLNLDGHQNNGAQLKQFIQRHGMLKQQDLSIAMVVTSREVLSALSQLVPCVGCRRSVERLFSQLVESGNPALEPLTVGPKGVLSVTRSCMTDAKKLYTLFYVHGSKLNDMIDAIPKSKKNKRCQLHSLDTHKPKPLGGCWMDVWELMSQECRDEVVLIDSSCLLETLETYLRKHRFCTDCKNKVLRAYNILIGELDCSKEKGYCAALYEGLRCCPHERHIHVCCETDFIAHLLGRAEPEFAGGRRERHAKTIDIAQEEVLTCLGIHLYERLHRIWQKLRAEEQTWQMLFYLGVDALRKSFEMTVEKVQGISRLEQLCEEFSEEERVRELKQEKKRQKRKNRRKNKCVCDIPTPLQTADEKEVSQEKETDFIENSSCKACGSTEDGNTCVEVIVTNENTSCTCPSSGNLLGSPKIKKGLSPHCNGSDCGYSSSMEGSETGSREGSDVACTEGICNHDEHGDDSCVHHCEDKEDDGDSCVECWANSEENDTKGKNKKKKKKSKILKCDEHIQKLGSCITDPGNRETSGNTMHTVFHRDKTKDTHPESCCSSEKGGQPLPWFEHRKNVPQFAEPTETLFGPDSGKGAKSLVELLDESECTSDEEIFISQDEIQSFMANNQSFYSNREQYRQHLKEKFNKYCRLNDHKRPICSGWLTTAGAN

SEQ ID NO: 47217 - protein, 515 aa, Homo sapiens
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSWSRSIAQAGMCSGVISAHYSLRFWGSTDPPTLASRVAGISDGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 47218 - protein, 253 aa, Homo sapiens
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGRNLLKEAQLSKAREA

SEQ ID NO: 47219 - protein, 456 aa, Homo sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKPKKVKDPLIKKNNTYAPTATSYTPNLARGDPGLATIAKSATIEPKEVKPETKPPEPKKTFNSVSKIDRLSRIAFPLLFGIFNLVYWATYLNREPQLKAPTPHQ

SEQ ID NO: 47220 - protein, 456 aa, Homo sapiens; identical to SEQ ID NO: 47219

SEQ ID NO: 47221 - protein, 456 aa, Homo sapiens; identical to SEQ ID NO: 47219

SEQ ID NO: 47222 - protein, 456 aa, Homo sapiens; identical to SEQ ID NO: 47219

SEQ ID NO: 47223 - protein, 456 aa, Homo sapiens; identical to SEQ ID NO: 47219

SEQ ID NO: 47224 - protein, 456 aa, Homo sapiens; identical to SEQ ID NO: 47219

SEQ ID NO: 47225 - protein, 123 aa, Homo sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWT

SEQ ID NO: 47226 - protein, 451 aa, Homo sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 47227 - protein, 451 aa, Homo sapiens; identical to SEQ ID NO: 47226

SEQ ID NO: 47228 - protein, 152 aa, Homo sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDG

SEQ ID NO: 47229 - protein, 137 aa, Homo sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAH

SEQ ID NO: 47230 - protein, 511 aa, Homo sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKSPSIKAEGITLTYNSVKAILQGAKLIWSKYIAFSWPSLFQEKTLEYLEKWMDCLTFKQSSKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 47231 - protein, 451 aa, Homo sapiens; identical to SEQ ID NO: 47226

SEQ ID NO: 47232 - protein, 451 aa, Homo sapiens; identical to SEQ ID NO: 47226

SEQ ID NO: 47233 - protein, 367 aa, Homo sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKVSESFRVIIIKKIP

SEQ ID NO: 47234 - protein, 456 aa, Homo sapiens
MRLKITLPSLREFLTDFWMVTIIGLDQDWEEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKSPSIKAEGITLTYNSVKAILQGAKLIWSKYIAFSWPSLFQEKTLEYLEKWMDCLTFKQSSKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 47235 - protein, 492 aa, Homo sapiens
MIITQTSHCYMTSLGILFLINILPGTTGQGESRRQEPGDFVKQDIGGLSPKHAPDIPDDSTDNITIFTRILDRLLDGYDNRLRPGLGDAVTEVKTDIYVTSFGPVSDTDMEYTIDVFFRQTWHDERLKFDGPMKILPLNNLLASKIWTPDTFFHNGKKSVAHNMTTPNKLLRLVDNGTLLYTMRLTIHAECPMHLEDFPMDVHACPLKFGSYAYTTAEVVYSWTLGKNKSVEVAQDGSRLNQYDLLGHVVGTEIIRSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRSWAWEGKKVPEALEMKKKTPAAPAKKTSTTFNIVGTTYPINLAKDTEFSTISKGAAPSASSTPTIIASPKATYVQDSPTETKTYNSVSKVDKISRIIFPVLFAIFNLVYWATYVNRESAIKGMIRKQ

SEQ ID NO: 47236 - protein, 492 aa, Homo sapiens; identical to SEQ ID NO: 47235

SEQ ID NO: 47237 - protein, 112 aa, Homo sapiens
EYTIDVFFRQTWHDERLKFDGPMKILPLNNLLASKIWTPDTFFHNGKKSVAHNMTTPNKLLRLVDNGTLLYTMRIEEVQKHRSMMKPSVSYTVAPWIQEGGPGGRHRLKMEK

SEQ ID NO: 47238 - protein, 492 aa, Homo sapiens; identical to SEQ ID NO: 47235

SEQ ID NO: 47239 - protein, 554 aa, Homo sapiens [sequence omitted]

SEQ ID NO: 47240 - protein, 462 aa, Homo sapiens
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMRLTISAECPMQLEDFPMDAHACPLKFGSYAYPNSEVVYVWTNGSTKSVVVAEDGSRLNQYHLMGQTVGTENISTSTGEYTIMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKKALEAAKIKKKREVILNKSTNAFTTGKMSHPPNIPKEQTPAGTSNTTSVSVKPSEEKTSESKKTYNSISKIDKMSRIVFPVLFGTFNLVYWATYLNREPVIKGAASPK

SEQ ID NO: 47241 - protein, 462 aa, Homo sapiens; identical to SEQ ID NO: 47240

SEQ ID NO: 47242 - protein, 462 aa, Homo sapiens; identical to SEQ ID NO: 47240

SEQ ID NO: 47243 - protein, 86 aa, Homo sapiens
MDNGMFSGFIMIKNLLLFCISMNLSSHFGFSQMPTSSVKDETNDNITIFTRILDGLLDGYDNRLRPGLGERITQVRTDIYVTSFGP

SEQ ID NO: 47244 - protein, 149 aa, Homo sapiens
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTP

SEQ ID NO: 47245 - protein, 166 aa, Homo sapiens
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMR

SEQ ID NO: 47246 - protein, 16 aa, Homo sapiens
MDNGMFSGFIMIKNLL

SEQ ID NO: 47247 - protein, 453 aa, Homo sapiens
MASSLPWLCIILWLENALGKLEVEGNFYSENVSRILDNLLEGYDNRLRPGFGGAVTEVKTDIYVTSFGPVSDVEMEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 47248 - protein, 443 aa, Homo sapiens
MASSLPWLCIILWLENALGKLEVEGNFYSENVSRILDNLLEGYDNRLRPGFGGAVTEVKTDIYVTSFGPVSDVEMTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 47249 - protein, 474 aa, Homo sapiens
MWTVQNRESLGLLSFPVMITMVCCAHSTNEPSNMSYVKETVDRLLKGYDIRLRPDFGGPPVDVGMRIDVASIDMVSEVNMDYTLTMYFQQSWKDKRLSYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWNGGEGAVTGVNKIELPQFSIVDYKMVSKKVEFTTGAYPRLSLSFRLKRNIGYFILQTYMPSTLITILSWVSFWINYDASAARVALGITTVLTMTTISTHLRETLPKIPYVKAIDIYLMGCFVFVFLALLEYAFVNYIFFGKGPQKKGASKQDQSANEKNKLEMNKVQVDAHGNILLSTLEIRNETSGSEVLTSVSDPKATMYSYDSASIQYRKPLSSREAYGRALDRHGVPSKGRIRRRASQLKVKIPDLTDVNSIDKWSRMFFPITFSLFNVVYWLYYVH

SEQ ID NO: 47250 - protein, 404 aa, Homo sapiens
MTFACGRTSEDYTLTMYFQQSWKDKRLSYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWNGGEGAVTGVNKIELPQFSIVDYKMVSKKVEFTTGAYPRLSLSFRLKRNIGYFILQTYMPSTLITILSWVSFWINYDASAARVALGITTVLTMTTISTHLRETLPKIPYVKAIDIYLMGCFVFVFLALLEYAFVNYIFFGKGPQKKGASKQDQSANEKNKLEMNKVQVDAHGNILLSTLEIRNETSGSEVLTSVSDPKATMYSYDSASIQYRKPLSSREAYGRALDRHGVPSKGRIRRRASQLKVKIPDLTDVNSIDKWSRMFFPITFSLFNVVYWLYYVH

SEQ ID NO: 47251 - protein, 512 aa, Homo sapiens
MWRVRKRGYFGIWSFPLIIAAVCAQSVNDPSNMSLVKETVDRLLKGYDIRLRPDFGGPPVAVGMNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKIFYKDIKQNGTQYRSLWDPTGNLSPTRRTTNYDFSLYTMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 47252 - protein, 474 aa, Homo sapiens
MWRVRKRGYFGIWSFPLIIAAVCAQSVNDPSNMSLVKETVDRLLKGYDIRLRPDFGGPPVAVGMNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 47253 - protein, 512 aa, Homo sapiens; identical to SEQ ID NO: 47251

SEQ ID NO: 47254 - protein, 314 aa, Homo sapiens
MMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 47255 - protein, 411 aa, Homo sapiens
MNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 47256 - protein, 474 aa, Homo sapiens; identical to SEQ ID NO: 47252

SEQ ID NO: 47257 - protein, 473 aa, Homo sapiens
MCSGLLELLLPIWLSWTLGTRGSEPRSVNDPGNMSFVKETVDKLLKGYDIRLRPDFGGPPVCVGMNIDIASIDMVSEVNMDYTLTMYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 47258 - protein, 473 aa, Homo sapiens [sequence omitted]

SEQ ID NO: 47259 - protein, 402 aa, Homo sapiens
MWATYQTEEDYTLTMYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 47260 - protein, 388 aa, Homo sapiens
MYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 47261 - protein, 138 aa, Homo sapiens
MYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNV

SEQ ID NO: 47262 - protein, 452 aa, Homo sapiens [sequence omitted]

SEQ ID NO: 47263 - protein, 506 aa, Homo sapiens
MLSKVLPVLLGILLILQSRVEGPQTESKNEASSRDVVYGPQPQPLENQLLSEETKSTETETGSRVGKLPEASRILNTILSNYDHKLRPGIGEKPTVVTVEISVNSLGPLSILDMEYTIDIIFSQTWYDERLCYNDTFESLVLNGNVVSQLWIPDTFFRNSKRTHEHEITMPNQMVRIYKDGKVLYTIRMTIDAGCSLHMLRFPMDSHSCPLSFSSFSYPENEMIYKWENFKLEINEKNSWKLFQFDFTGVSNKTEIITTPVGDFMVMTIFFNVSRRFGYVAFQNYVPSSVTTMLSWVSFWIKTESAPARTSLGITSVLTMTTLGTFSRKNFPRVSYITALDFYIAICFVFCFCALLEFAVLNFLIYNQTKAHASPKLRHPRINSRAHARTRARSRACARQHQEAFVCQIVTTEGSDGEERPSCSAQQPPSPGSPEGPRSLCSKLACCEWCKRFKKYFCMVPDCEGSTWQQGRLCIHVYRLDNYSRVVFPVTFFFFNVLYWLVCLNL

SEQ ID NO: 47264 - protein, 139 aa, Homo sapiens
MRSPCPTRWSASTRMARCCTQLVSYPENEMIYKWENFKLEINEKNSWKLFQFDFTGVSNKTEIITTPVGDLNEEPRDLPRVAPRATLETLFTHPDQVQGSEGTALIVSRMWMEPVTQPAICRERHLVLLPFKIPRQEDF

SEQ ID NO: 47265 - protein, 465 aa, Homo sapiens
MGPLKAFLFSPFLLRSQSRGVRLVFLLLTLHLGNCVDKADDEDDEDLTVNKTWVLAPKIHEGDITQILNSLLQGYDNKLRPDIGVRPTVIETDVYVNSIGPVDPINMEYTIDIIFAQTWFDSRLKFNSTMKVLMLNSNMVGKIWIPDTFFRNSRKSDAHWITTPNRLLRIWNDGRVLYTLRLTINAECYLQLHNFPMDEHSCPLEFSSYGYPKNEIEYKWKKPSVEVADPKYWRLYQFAFVGLRNSTEITHTISGDYVIMTIFFDLSRRMGYFTIQTYIPCILTVVLSWVSFWINKDAVPARTSLGITTVLTMTTLSTIARKSLPKVSYVTAMDLFVSVCFIFVFAALMEYGTLHYFTSNQKGKTATKDRKLKNKASMTPGLHPGSTLIPMNNISVPQEDDYGYQCLEGKDCASFFCCFEDCRTGSWREGRIHIRIAKIDSYSRIFFPTAFALFNLVYWVGYLYL

SEQ ID NO: 47266 - protein, 419 aa, Homo sapiens
MGPLKAFLFSPFLLRSQSRGVRLVFLLLTLHLGNCVDKADDEDDEDLTVNKTWVLAPKIHEGDITQILNSLLQGYDNKLRPDIGVRPTVIETDVYVNSIGPVDPINMEYTIDIIFAQTWFDSRLKFNSTMKVLMLNSNMVGKIWIPDTFFRNSRKSDAHWITTPNRLLRIWNDGRVLYTLRLTINAECYLQLHNFPMDEHSCPLEFSSYGYPKNEIEYKWKKPSVEVADPKYWRLYQFAFVGLRNSTEITHTISGDYVIMTIFFDLSRRMGYFTIQTYIPCILTVVLSWVSFWINKDAVPARTSLGITTVLTMTTLSTIARKSLPKVSYVTAMDLFVSVCFIFVFAALMEYGTLHYFTSNQKGKTATKDRKLKNKASMTPGLHPGSTLIPMNNISVPQEDDYGYQCLEGRKDTHTHCQN

SEQ ID NO: 47267 - protein, 475 aa, Homo sapiens
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 47268 - protein, 467 aa, Homo sapiens
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 47269 - protein, 372 aa, Homo sapiens
MYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 47270 - protein, 467 aa, Homo sapiens
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPTAMITLNNSVYWQEFEDTCVYECLDGKDCQSFFCCYEECKSGSWRKGRIHIDILELDSYSRVFFPTSFLLFNLVYWVGYLYL

SEQ ID NO: 47271 - protein, 440 aa, Homo sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGVTTVLSMTTLMIGSRTSLPNTNCFIKAIDVYLGICFSFVFGALLEYAVAHYSSLQQMAAKDRGTTKEVEEVSITNIINSSISSFKRKISFASIEISSDNVDYSDLTMKTSDKFKFVFREKMGRIVDYFTIQNPSNVDHYSKLLFPLIFMLANVFYWAYYMYF

SEQ ID NO: 47272 - protein, 52 aa, Homo sapiens
MNYSLHLAFVCLSLFTERMCIQGSQFNVEVGRSDKLSLPGFENLTAGYNKFL

SEQ ID NO: 47273 - protein, 440 aa, Homo sapiens; identical to SEQ ID NO: 47271

SEQ ID NO: 47274 - protein, 59 aa, Homo sapiens
MNYSLHLAFVCLSLFTERMCIQGSQFNVEVGRSDKLSLPGFENLTAGYNKFLRPNFGGE

SEQ ID NO: 47275 - protein, 92 aa, Homo sapiens
MNYSLHLAFVCLSLFTERMCIQGSQFNVEVGRSDKLSLPGFENLTAGYNKFLRPNFGGEPVQIALTLDIASISSISESNMDYTATIYLRQRW

SEQ ID NO: 47276 - protein, 171 aa, Homo sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDT

SEQ ID NO: 47277 - protein, 189 aa, Homo sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVE

SEQ ID NO: 47278 - protein, 187 aa, Homo sapiens
MDYTATIYLRQRWMDQRLVFEGNKSFTLDEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGDNKGSRRSQYY

SEQ ID NO: 47279 - protein, 941 aa, Homo sapiens
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHAYLPSIGGVDASCVSPCVSPTASPRHRHVPPSFRVMVSGL

SEQ ID NO: 47280 - protein, 392 aa, Homo sapiens
MRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 47281 - protein, 462 aa, Homo sapiens
MLAVPNMRFGIFLLWWGWVLATESRMHWPGREVHEMSKKGSPILRRSPDITKSPLTKSEQLLRIDDHDFSMRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 47282 - protein, 392 aa, Homo sapiens; identical to SEQ ID NO: 47280

SEQ ID NO: 47283 - protein, 479 aa, Homo sapiens
MLAVPNMRFGIFLLWWGWVLATESRMHWPGREVHEMSKKGRPQRQRREVHEDAHKQVSPILRRSPDITKSPLTKSEQLLRIDDHDFSMRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 47284 - protein, 490 aa, Homo sapiens
MVKPGGICSATGYWKAAFCLTDVHKMPYFTRLILFLFCLMVLVESRKPKRKRWTGQVEMPKPSHLYKKNLDVTKIRKGKPQQLLRVDEHDFSMRPAFGGPAIPVGVDVQVESLDSISEVDMDFTMTLYLRHYWKDERLAFSSASNKSMTFDGRLVKKIWVPDVFFVHSKRSFTHDTTTDNIMLRVFPDGHVLYSMRITVTAMCNMDFSHFPLDSQTCSLELESYAYTDEDLMLYWKNGDESLKTDEKISLSQFLIQKFHTTSRLAFYSSTGWYNRLYINFTLRRHIFFFLLQTYFPATLMVMLSWVSFWIDRRAVPARVSLGITTVLTMTTIITGVNASMPRVSYVKAVDIYLWVSFVFVFLSVLEYAAVNYLTTVQERKERKLREKFPCMCGMLHSKTMMLDGSYSESEANSLAGYPRSHILTEEERQDKIVVHLGLSGEANAARKKGLLKGQTGFRIFQNTHAIDKYSRLIFPASYIFFNLIYWSVFS

SEQ ID NO: 47285 - protein, 150 aa, Homo sapiens
MLRAAVILLLIRTWLAEGNYPSPIPKFHFEFSSAVPEVVLNLFNCKNCANEAVVQKILDRVLSRYDVRLRPNFGGVLETNSTWGLNDDELMAHGQEKDSSSESEDSCPPSPGCSFTEGFSFDLFNPDYVPKVDKWSRFLFPLAFGLFNIV

SEQ ID NO: 47286 - protein, 632 aa, Homo sapiens
MGIRGMLRAAVILLLIRTWLAEGNYPSPIPKFHFEFSSAVPEVVLNLFNCKNCANEAVVQKILDRVLSRYDVRLRPNFGGAPVPVRISIYVTSIEQISEMNMDYTITMFFHQTWKDSRLAYYETTLNLTLDYRMHEKLWVPDCYFLNSKDAFVHDVTVENRVFQLHPDGTVRYGIRLTTTAACSLDLHKFPMDKQACNLVVESYGYTVEDIILFWDDNGNAIHMTEELHIPQFTFLGRTITSKEVYFYTGSYIRLILKFQVQREVNSYLVQVYWPTVLTTITSWISFWMNYDSSAARVTIGLTSMLILTTIDSHLRDKLPNISCIKAIDIYILVCLFFVFLSLLEYVYINYLFYSRGPRRQPRRHRRPRRVIARYRYQQVVVGNVQDGLINVEDGVSSLPITPAQAPLASPESLGSLTSTSEQAQLATSESLSPLTSLSGQAPLATGESLSDLPSTSEQARHSYGVRFNGFQADDSIFPTEIRNRVEAHGHGVTHDHEDSNESLSSDERHGHGPSGKPMLHHGEKGVQEAGWDLDDNNDKSDCLAIKEQFKCDTNSTWGLNDDELMAHGQEKDSSSESEDSCPPSPGCSFTEGFSFDLFNPDYVPKVDKWSRFLFPLAFGLFNIVYWVYHMY

SEQ ID NO: 47287 - protein, 758 aa, Homo sapiens
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 47288 - protein, 701 aa, Homo sapiens
MAVSAGSARTSPSSGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 47289 - protein, 318 aa, Homo sapiens
MASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAKIFYNLSIQSFDDGDYFPVWGTCLGFEELSLLISGECLLTATDTVDVAMPLNFTGGQLHSRMFQNFPTELLLSLAVEPLTANFHKWSLSVKNFTMNEKLKKFFNVLTTNTDGKIEFISTMEGYKYPVYGVQWHPEKAPYEWKNLDGISHAPNAVKTAFYLAEFFVNEARKNNHHFKSESEEEKALIYQFSPIYTGNISSFQQCYIFD

SEQ ID NO: 47290 - protein, 114 aa, Homo sapiens
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDELFAWVQKKMVCRWSIKRS

SEQ ID NO: 47291 - protein, 188 aa, Homo sapiens
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEQEGVKSGMYVVIEVKVATQEGKEITCRSYLMTNYESAPPSPQYKKIICMGAKENGLPLEYQEKLKAIEPNDYTGKVSEEIEDIIKKGETQTL

SEQ ID NO: 47292 - protein, 127 aa, Homo sapiens [sequence omitted]

SEQ ID NO: 47293 - protein, 94 aa, Homo sapiens
MANSGCKDVTGPDEESFLYFAYGSNLLTERIHLRNPSAAFFCVARLQIICMGAKENGLPLEYQEKLKAIEPNDYTGKVSEEIEDIIKKGETQTL

SEQ ID NO: 47294 - protein, 166 aa, Homo sapiens
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEWRKKRHTAFQNQGNHPCKHKTRMWDRDPKIPVQNLSLALCWQAQSGHGTCNRLFAWVQKKMVCRWSIKRS

SEQ ID NO: 47295 - protein, 569 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDVVLYMPSAPLSGPVLALILNILKGYNFSRESVESPEQKGLTYHRIVEAFRFAYAKRTLLGDPKFVDVTEVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 47296 - protein, 569 aa, Homo sapiens; identical to SEQ ID NO: 47295

SEQ ID NO: 47297 - protein, 569 aa, Homo sapiens; identical to SEQ ID NO: 47295

SEQ ID NO: 47298 - protein, 569 aa, Homo sapiens; identical to SEQ ID NO: 47295

SEQ ID NO: 47299 - protein, 225 aa, Homo sapiens
MTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 47300 - protein, 225 aa, Homo sapiens; identical to SEQ ID NO: 47299

SEQ ID NO: 47301 - protein, 225 aa, Homo sapiens; identical to SEQ ID NO: 47299

SEQ ID NO: 47302 - protein, 569 aa, Homo sapiens; identical to SEQ ID NO: 47295

SEQ ID NO: 47303 - protein, 120 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFN

SEQ ID NO: 47304 - protein, 463 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDVVLYMPSAPLSGPVLALILNILKGYNFSRESVESPEQKGLTYHRIVEAFRFAYAKRTLLGDPKFVDVTEVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDG

SEQ ID NO: 47305 - protein, 80 aa, Homo sapiens
MKKKLVVLGLLAVVLVLVIVGLCLWLPSASKEPDNHVYTRAAVAADAKQCSKIGRDALRDGGSAVDAAIAALLCVGLMNA

SEQ ID NO: 47306 - protein, 174 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGL

SEQ ID NO: 47307 - protein, 126 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQ

SEQ ID NO: 47308 - protein, 109 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREV

SEQ ID NO: 47309 - protein, 111 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAP

SEQ ID NO: 47310 - protein, 37 aa, Homo sapiens
MKKKLVVLGLLAVVLVLVIVGLCLWLPSASKEPDNHV

SEQ ID NO: 47311 - protein, 68 aa, Homo sapiens
MKKKLVVLGLLAVVLVLVIVGLCLWLPSASKEPDNHVYTRAAVAADAKQCSKIGRDALRDGGSAVDAA

SEQ ID NO: 47312 - protein, 126 aa, Homo sapiens; identical to SEQ ID NO: 47307

SEQ ID NO: 47313 - protein, 116 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFA

SEQ ID NO: 47314 - protein, 127 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQK

SEQ ID NO: 47315 - protein, 98 aa, Homo sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTT

SEQ ID NO: 47316 - protein, 30 aa, Homo sapiens
MKKKLVVLGLLAVVLVLVIVGLCLWLPSAS

SEQ ID NO: 47317 - protein, 569 aa, Homo sapiens
MKKKLVVLGLLAVVLVLVIVGLCLWLPSASKEPDNHVYTRAAMAADAKQCLEIGRDTLRDGGSAVDAAIAALLCVGLMNAHSMGIGVGLFLTIYNSTTRKAEVINAREVAPRLAFASMFNSSEQSQKGGLSVAVPGEIRGYELAHQRHGRLPWARLFQPSIQLARQGFPVGKGLAAVLENKRTVIEQQPVLWYVFCRDRKVLREGERLTLPRLADTYEMLAIEGAQAFYNGSLMAQIVKDIQAAGGIVTAEDLNNYRAELIEHPLNISLGDAVLYMPSARLSGPVLALILNILKGYNFSRESVETPEQKGLTYHRIVEAFRFAYAKRTLLGDPKFVDVTEVVRNMTSEFFAAQLRSQISDHTTHPISYYKPEFYTPDDGGTAHLSVVAEDGSAVSATSTINLYFGSKVCSPVSGILFNNEWTTSALPAFTNEFGAPPSPANFIQPGKQPLLSMCLTIMVGQDGQVRMVVGAAGGTQITTDTALAIIYNLWFGYDVKRAVEEPRLHNKLLPNVTTVERNIDQAVTAALETRHHHTQIASTFIAVVQAIVRTAGGWAAASDSRKGGEPAGY

SEQ ID NO: 47318 - protein, 559 aa, Homo sapiens
MKKKLVVLGLLAVVLVLVIVGLCLWLPSASKEPDNHVYTRAAMAADAKQCLEIGRDTLRDGGSAVDAAIAALLCVGLMNAHSMGIGVGLFLTIYNSTTRKAEVINAREVAPRLAFASMFNSSEQSQKGGLSVAVPGEIRGYELAHQRHGRLPWARLFQPSIQLARQGFPVGKGLAAVLENKRTVIEQQPVLWYVFCRDRKVLREGERLTLPRLADTYEMLAIEGAQAFYNGSLMAQIVKDIQAAGGIVTAEDLNNYRAELIEHPLNISLGDAVLYMPSARLSGPVLALILNILKGYNFSRESVETPEQKGLTYHRIVEAFRFAYAKRTLLGDPKFVDVTEVVRNMTSEFFAAQLRSQISDHTTHPISYYKPEFYTPDDGGTAHLSVVAEDGSAVSATSTINLYGILFNNEWTTSALPAFTNEFGAPPSPANFIQPGKQPLLSMCLTIMVGQDGQVRMVVGAAGGTQITTDTALAIIYNLWFGYDVKRAVEEPRLHNKLLPNVTTVERNIDQAVTAALETRHHHTQIASTFIAVVQAIVRTAGGWAAASDSRKGGEPAGY

SEQ ID NO: 47319 - protein, 569 aa, Homo sapiens; identical to SEQ ID NO: 47317

SEQ ID NO: 47320 - protein, 554 aa, Homo sapiens
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 47321 - protein, 586 aa, Homo sapiens
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGKVEVINARETVPASHAPSLLDQCAQALPLGTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 47322 - protein, 587 aa, Homo sapiens
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGKVEVINARETVPASHAPSLLDQCAQALPLGTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPAVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 47323 - protein, 510 aa, Homo sapiens
MARGYGATVSLVLLGLGLALAVIVLAVVLSRHQAPCGPQAFAHAAVAADSKVCSDIGRGPVDRGARGAPWLCRGPPPPWPPALGAAVPAHHRAAPRGACGGPCPQPFPAQQHPAAFLAGVNPALFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPAVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 47324 - protein, 501 aa, Homo sapiens
MGLGGGVIFTIYNVTTGKVEVINARETVPASHAPSLLDQCAQALPLGTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 47325 - protein, 461 aa, Homo sapiens
MERAEEPVVYQKLLPWEPSLESEEEVEEEETSEALVLNPRRHQDSSRNKAGGLPGTWARVVAALLLLAVGCSLAVRQLQNQGRSTGSLGSVAPPPGGHSHGPGVYHHGAIISPAGAMFWGLFHDSSSGNSTALTSGPAQTLAPGLGLPAALPTLHLLHARFGRLPWPRLLVGPTTLAQEGFLVDTPLARALVARGTEGLCPLLCHADGTPLGAGARATNPQLAAVLRSAALAPTSDLAGDALLSLLAGDLGVEVPSAVPRPTLEPAEQLPVPQGILFTTPSPSAGPELLALLEAALRSGAPIPDPCPPFLQTAVSPESSALAAVDSSGSVLLLTSSLNCSFGSAHLSPSTGVLLSNLVAKSTTSAWACPLILRGSLDDTEADVLGLVASGTPDVARAMTHTLLRHLAARPPTQAQHQHQGQQEPTEHPSTCGQGTLLQVAAHTEHAHVSSVPHACCPFQGF

SEQ ID NO: 47326 - protein, 493 aa, Homo sapiens
MERAEEPVVYQKLLPWEPSLESEEEVEEEETSEALVLNPRRHQDSSRNKAGGLPGTWARVVAALLLLAVGCSLAVRQLQNQGRSTGSLGSVAPPPGGHSHGPGVYHHGAIISPAGRELLVAGGNVVDAGVGAALCLAVVHPHATGLGAMFWGLFHDSSSGNSTALTSGPAQTLAPGLGLPAALPTLHLLHARFGRLPWPRLLVGPTTLAQEGFLVDTPLARALVARGTEGLCPLLCHADGTPLGAGARATNPQLAAVLRSAALAPTSDLAGDALLSLLAGDLGVEVPSAVPRPTLEPAEQLPVPQGILFTTPSPSAGPELLALLEAALRSGAPIPDPCPPFLQTAVSPESSALAAVDSSGSVLLLTSSLNCSFGSAHLSPSTGVLLSNLVAKSTTSAWACPLILRGSLDDTEADVLGLVASGTPDVARAMTHTLLRHLAARPPTQAQHQHQGQQEPTEHPSTCGQGTLLQVAAHTEHAHVSSVPHACCPFQGF

SEQ ID NO: 47327 - protein, 345 aa, Homo sapiens
MFWGLFHDSSSGNSTALTSGPAQTLAPGLGLPAALPTLHLLHARFGRLPWPRLLVGPTTLAQEGFLVDTPLARALVARGTEGLCPLLCHADGTPLGAGARATNPQLAAVLRSAALAPTSDLAGDALLSLLAGDLGVEVPSAVPRPTLEPAEQLPVPQGILFTTPSPSAGPELLALLEAALRSGAPIPDPCPPFLQTAVSPESSALAAVDSSGSVLLLTSSLNCSFGSAHLSPSTGVLLSNLVAKSTTSAWACPLILRGSLDDTEADVLGLVASGTPDVARAMTHTLLRHLAARPPTQAQHQHQGQQEPTEHPSTCGQGTLLQVAAHTEHAHVSSVPHACCPFQGF

SEQ ID NO: 47328 - protein, 493 aa, Homo sapiens; identical to SEQ ID NO: 47326

SEQ ID NO: 47329 - protein, 225 aa, Homo sapiens
MTSEFFSAQLRAQISDDTTHPISYYKPEFYMPDDGGTAHLSVVAEDGSAVSATSTINLYFGSKVRSPVSGILLNNEMDDFSSTSITNEFGVPPSPANFIQPGKQPLSSMCPTIMVGQDGQVRMVVGAAGGTQITMATALAIIYNLWFGYDVKWAVEEPRLHNQLLPNVTTVERNIDQEVTAALETRHHHTQITSTFIAVVQAIVRMAGGWAAASDSRKGGEPAGY

SEQ ID NO: 47330 - protein, 225 aa, Homo sapiens; identical to SEQ ID NO: 47329

SEQ ID NO: 47331 - protein, 225 aa, Homo sapiens; identical to SEQ ID NO: 47329

SEQ ID NO: 47332 - protein, 225 aa, Homo sapiens
MTSEFFAAQLRAQISDDTTHPISYYKPEFYTPVDGGTAHLSVVAEDGSAVSATSTINLYFGSKVRSPVSEILFNDEMDDFSSPNITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 47333 - protein, 218 aa, Homo sapiens
MTSEFFAAQLRAQISDDTTHPISYYKPEFYTPVDGGTAHLSVVAEDGSAVSATSTINLYFGSKVRSPVSEILFNDEMDDFSSPNITNEFGVPPSPANFIQPGKQPLSSMCPTIMVGQDGQPPSHADHTPMPQAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 47334 - protein, 225 aa, Homo sapiens
MTSEFFAAQLRSQISDHTTHPISYYKPEFYTPDDGGTAHLSVVAEDGSAVSATSTINLYFGSKVCSPVSGILFNNEWTTSALPAFTNEFGAPPSPANFIQPGKQPLLSMCPTIMVGQDGQVRMVVGAAGGTQITTDTALAIIYNLWFGYDVKRAVEEPRLHNKLLPNVTTVERNIDQAVTAALETRHHHTQIASTFIAVVQAIVRTAGGWAAASDSRKGGEPAGY

SEQ ID NO: 47335 - protein, 236 aa, Homo sapiens
PALGSQQVVRNMTSEFFAAQLRSQISDHTTHPISYYKPEFYTPDDGGTAHLSVVAEDGSAVSATSTINLYFGSKVCSPVSGILFNNEWTTSALPAFTNEFGAPPSPANFIQPGKQPLLSMCPTIMVGQDGQVRMVVGAAGGTQITTDTALAIIYNLWFGYDVKRAVEEPRLHNKLLPNVTTVERNIDQAVTAALETRHHHTQIASTFIAVVQAIVRTAGGWAAASDSRKGGEPAGY

SEQ ID NO: 47336 - protein, 358 aa, Homo sapiens
MAERQEEQRGSPPLRAEGKADAEVKLILYHWTHSFSSQKVRLVIAEKALKCEEHDVSLPLSEHNEPWFMRLNSTGEVPVLIHGENIICEATQIIDYLEQTFLDERTPRLMPDKESMYYPRVQHYRELLDSLPMDAYTHGCILHPELTVDSMIPAYATTRIRSQIGNTESELKKLAEENPDLQEAYIAKQKRLKSKLLDHDNVKYLKKILDELEKVLDQVETELQRRNEETPEEGQQPWLCGESFTLADVSLAVTLHRLKFLGFARRNWGNGKRPNLETYYERVLKRKTFNKVLGHVNNILISAVLPTAFRVAKKRAPKVLGTTLVVGLLAGVGYFAFMLFRKRLGSMILAFRPRPNYF

SEQ ID NO: 47337 - protein, 290 aa, Homo sapiens
MRLNSTGEVPVLIHGENIICEATQIIDYLEQTFLDERTPRLMPDKESMYYPRVQHYRELLDSLPMDAYTHGCILHPELTVDSMIPAYATTRIRSQIGNTESELKKLAEENPDLQEAYIAKQKRLKSKLLDHDNVKYLKKILDELEKVLDQVETELQRRNEETPEEGQQPWLCGESFTLADVSLAVTLHRLKFLGFARRNWGNGKRPNLETYYERVLKRKTFNKVLGHVNNILISAVLPTAFRVAKKRAPKVLGTTLVVGLLAGVGYFAFMLFRKRLGSMILAFRPRPNYF

SEQ ID NO: 47338 - protein, 543 aa, Homo sapiens
MGDWNLLGGILEEVHSHSTIVGKIWLTILFIFRMLVLRVAAEDVWDDEQSAFACNTRQPGCNNICYDDAFPISLIRFWVLQIIFVSSPSLVYMGHALYRLRAFEKDRQRKKSHLRAQMENPDLDLEEQQRIDRELRRLEEQKRIHKVPLKGCLLRTYVLHILTRSVLEVGFMIGQYILYGFQMHPLYKCTQPPCPNAVDCFVSRPTEKTIFMLFMHSIAAISLLLNILEIFHLGIRKIMRTLYKKSSSEGIEDETGPPFHLKKYSVAQQCMICSSLPERISPLQANNQQQVIRVNVPKSKTMWQIPQPRQLEVDPSNGKKDWSEKDQHSGQLHVHSPCPWAGSAGNQHLGQQSDHSSFGLQNTMSQSWLGTTTAPRNCPSFAVGTWEQSQDPEPSGEPLTDLHSHCRDSEGSMRESGVWIDRSRPGSRKASFLSRLLSEKRHLHSDSGSSGSRNSSCLDFPHWENSPSPLPSVTGHRTSMVRQAALPIMELSQELFHSGCFLFPFFLPGVCMYVCVDREADGGGDYLWRDKIIHSIHSVKFNS

SEQ ID NO: 47339 - protein, 435 aa, Homo sapiens
MGDWSFLGRLLENAQEHSTVIGKVWLTVLFIFRILVLGAAAEDVWGDEQSDFTCNTQQPGCENVCYDRAFPISHIRFWALQIIFVSTPTLIYLGHVLHIVRMEEKKKEREEEEQLKRESPSPKEPPQDNPSSRDDRGRVRMAGALLRTYVFNIIFKTLFEVGFIAGQYFLYGFELKPLYRCDRWPCPNTVDCFISRPTEKTIFIIFMLAVACASLLLNMLEIYHLGWKKLKQGVTSRLGPDASEAPLGTADPPPLPPSSRPPAVAIGFPPYYAHTAAPLGQARAVGYPGAPPPAADFKLLALTEARGKGQSAKLYNGHHHLLMTEQNWANQAAERQPPALKAYPAASTPAAPSPVGSSSPPLAHEAEAGAAPLLLDGSGSSLEGSALAGTPEEEEQAVTTAAQMHQPPLPLGDPGRASKASRASSGRARPEDLAI

SEQ ID NO: 47340 - protein, 333 aa, Homo sapiens
MGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWANLTTEERLASSRPPLFLDPPPQNGQKPPSRPSSSASKKQYV

SEQ ID NO: 47341 - protein, 292 aa, Homo sapiens
MGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWA

SEQ ID NO: 47342 - protein, 293 aa, Homo sapiens
MGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTPQTLTRTRSSSTSPWARGPHPHHAPPTMGSHPVSRTGPT

SEQ ID NO: 47343 - protein, 358 aa, Homo sapiens
MGDWSFLGNFLEEVHKHSTVVGKVWLTVLFIFRMLVLGTAAESSWGDEQADFRCDTIQPGCQNVCYDQAFPISHIRYWVLQIIFVSTPSLVYMGHAMHTVRMQEKRKLREAERAKEVRGSGSYEYPVAEKAELSCWEEGNGRIALQGTLLNTYVCSILIRTTMEVGFIVGQYFIYGIFLTTLHVCRRSPCPHPVNCYVSRPTEKNVFIVFMLAVAALSLLLSLAELYHLGWKKIRQRFVKPRQHMAKCQLSGPSVGIVQSCTPPPDFNQCLENGPGGKFFNPFSNNMASQQNTDNLVTEQVRGQEQTPGEGFIQVRYGQKPEVPNGVSPGHRLPHGYHSDKRRLSKASSKARSDDLSV

SEQ ID NO: 47344 - protein, 358 aa, Homo sapiens; identical to SEQ ID NO: 47343

SEQ ID NO: 47345 - protein, 252 aa, Homo sapiens
MGDWSFLGNFLEEVHKHSTVVGKVWLTVLFIFRMLVLGTAAESSWGDEQADFRCDTIQPGCQNVCYDQAFPISHIRYWVLQIIFVSTPSLVYMGHAMHTVRMQEKRKLREAERAKEVRGSGSYEYPVAEKAELSCWEEGNGRIALQGTLLNTYVCSILIRTTMEVGFIVGQYFIYGIFLTTLHVCRRSPCPHPVNCYVSRPTEKNVFIVFMLAVAALSLLLSLAELYHLGWKKIRQRFVKPRQHMAKCQLSG

SEQ ID NO: 47346 - protein, 433 aa, Homo sapiens
MGDWSFLGNILEEVNEHSTVIGRVWLTVLFIFRILILGTAAEFVWGDEQSDFVCNTQQPGCENVCYDEAFPISHIRLWVLQIIFVSTPSLMYVGHAVHYVRMEEKRKSREAEELGQQAGTNGGPDQGSVKKSSGSKGTKKFRLEGTLLRTYICHIIFKTLFEVGFIVGHYFLYGFRILPLYRCSRWPCPNVVDCFVSRPTEKTIFILFMLSVASVSLFLNVMELGHLGLKGIRSALKRPVEQPLGEIPEKSLHSIAVSSIQKAKGYQLLEEEKIVSHYFPLTEVGMVETSPLPAKPFNQFEEKISTGPLGDLSRGYQETLPSYAQVGAQEVEGEGPPAEEGAEPEVGEKKEEAERLTTEEQEKVAVPEGEKVETPGVDKEGEKEEPQSEKVSKQGLPAEKTPSLCPELTTDDARPLSRLSKASSRARSDDLTV

SEQ ID NO: 47347 - protein, 433 aa, Homo sapiens; identical to SEQ ID NO: 47346

SEQ ID NO: 47348 - protein, 515 aa, Homo sapiens
MGDWNLLGDTLEEVHIHSTMIGKIWLTILFIFRMLVLGVAAEDVWNDEQSGFICNTEQPGCRNVCYDQAFPISLIRYWVLQVIFVSSPSLVYMGHALYRLRVLEEERQRMKAQLRVELEEVEFEMPRDRRRLEQELCQLEKRKLNKAPLRGTLLCTYVIHIFTRSVVEVGFMIGQYLLYGFHLEPLFKCHGHPCPNIIDCFVSRPTEKTIFLLFMQSIATISLFLNILEIFHLGFKKIKRGLWGKYKLKKEHNEFHANKAKQNVAKYQSTSANSLKRLPSAPDYNLLVEKQTHTAVYPSLNSSSVFQPNPDNHSVNDEKCILDEQETVLSNEISTLSTSCSHFQHISSNNNKDTHKIFGKELNGNQLMEKRETEGKDSKRNYYSRGHRSIPGVAIDGENNMRQSPQTVFSLPANCDWKPRWLRATWGSSTEHENRGSPPKGNLKGQFRKGTVRTLPPSQGDSQSLDIPNTADSLGGLSFEPGLVRTCNNPVCPPNHVVSLTNNLIGRRVPTDLQI

SEQ ID NO: 47349 - protein, 515 aa, Homo sapiens; identical to SEQ ID NO: 47348

SEQ ID NO: 47350 - protein, 514 aa, Homo sapiens
MGDWNLLGDTLEEVHIHSTMIGKIWLTILFIFRMLVLGVAAEDVWNDEQSGFICNTEQPGCRNVCYDQAFPISLIRYWVLQVIFVSSPSLVYMGHALYRLRVLEEERQRMKAQLRVELEEVEFEMPRDRRRLEQELCQLEKRKLNKAPLRGTLLCTYVIHIFTRSVVEVGFMIGQYLLYGFHLEPLFKCHGHPCPNIIDCFVSRPTEKTIFLLFMQSIATISLFLNILEIFHLGFKKIKRGLWGKYKLKKEHNEFHANKAKQNVAKYQSTSANSLKRLPSAPDYNLLVEKQTHTAVYPSLNSSSVFQPNPDNHSVNDEKCILDEQETVLSNEISTLSTSCSHFQHISSNNNKDTHKIFGKELNGNQLMEKRETEGKDSKRNYYSRGHRSIPGVAIDGENNMRQSPQTVFSLPANCDWKPRWLRATWGSSTEHENRGSPPKVPGSKATASSLLLILQRPTSSQPRLKETPKIKAEAKIYDSKHPPRLLQSTVSTFSGREPRSPAPMGHHSFRGPR

SEQ ID NO: 47351 - protein, 283 aa, Homo sapiens
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGHGDPLHLEEVKRHKVHISGTLWWTYVISVVFRLLFEAVFMYVFYLLYPGYAMVRLVKCDVYPCPNTVDCFVSRPTEKTVFTVFMLAASGICIILNVAEVVYLIIRACARRAQRRSNPPSRKGSGFGHRLSPEYKQNEINKLLSEQDGSLKDILRRSPGTGAGLAEKSDRCSAC

SEQ ID NO: 47352 - protein, 283 aa, Homo sapiens; identical to SEQ ID NO: 47351

SEQ ID NO: 47353 - protein, 283 aa, Homo sapiens; identical to SEQ ID NO: 47351

SEQ ID NO: 47354 - protein, 84 aa, Homo sapiens
MNWTGLYTLLSGVNRHSTAIGRVWLSVIFIFRIMVLVVAAESVWGDEKSSFICNTLQPGCNSVCYDQFFPISHVRLWSLQLILV

SEQ ID NO: 47355 - protein, 226 aa, Homo sapiens
MDWGTLQTILGGVNKHSTSIGKIWLTVLFIFRIMILVVAAKEVWGDEQADFVCNTLQPGCKNVCYDHYFPISHIRLWALQLIFVSTPALLVAMHVAYRRHEKKRKFIKGEIKSEFKDIEEIKTQKVRIEGSLWWTYTSSIFFRVIFEAAFMYVFYVMYDGFSMQRLVKCNAWPCPNTVDCFVSRPTEKTVFTVFMIAVSGICILLNVTELCYLLIRYCSGKSKKPV

SEQ ID NO: 47356 - protein, 226 aa, Homo sapiens; identical to SEQ ID NO: 47355

SEQ ID NO: 47357 - protein, 270 aa, Homo sapiens
MDWKTLQALLSGVNKYSTAFGRIWLSVVFVFRVLVYVVAAERVWGDEQKDFDCNTKQPGCTNVCYDNYFPISNIRLWALQLIFVTCPSLLVILHVAYREERERRHRQKHGDQCAKLYDNAGKKHGGLWWTYLFSLIFKLIIEFLFLYLLHTLWHGFNMPRLVQCANVAPCPNIVDCYIARPTEKKIFTYFMVGASAVCIVLTICELCYLICHRVLRGLHKDKPRGGCSPSSSASRASTCRCHHKLVEAGEVDPDPGNNKLQASAPNLTPI

SEQ ID NO: 47358 - protein, 270 aa, Homo sapiens; identical to SEQ ID NO: 47357

SEQ ID NO: 47359 - protein, 254 aa, Homo sapiens
MDWKTLQALLSGVNKYSTAFGRIWLSVVFVFRVLVYVVAAERVWGDEQKDFDCNTKQPGCTNVCYDNYFPISNIRLWALQLIFVTCPSLLVILHVAYREERERRHRQKHGDQCAKLYDNAGKKHGGLWWTYLLHTLWHGFNMPRLVQCANVAPCPNIVDCYIARPTEKKIFTYFMVGASAVCIVLTICELCYLICHRVLRGLHKDKPRGGCSPSSSASRASTCRCHHKLVEAGEVDPDPGNNKLQASAPNLTPI

SEQ ID NO: 47360 - protein, 266 aa, Homo sapiens
MNWAFLQGLLSGVNKYSTVLSRIWLSVVFIFRVLVYVVAAEEVWDDEQKDFVCNTKQPGCPNVCYDEFFPVSHVRLWALQLILVTCPSLLVVMHVAYREERERKHHLKHGPNAPSLYDNLSKKRGGLWWTYLLSLIFKAAVDAGFLYIFHRLYKDYDMPRVVACSVEPCPHTVDCYISRPTEKKVFTYFMVTTAAICILLNLSEVFYLVGKRCMEIFGPRHRRPRCRECLPDTCPPYVLSQGGHPEDGNSVLMKAGSAPVDAGGYP

SEQ ID NO: 47361 - protein, 273 aa, Homo sapiens
MNWSIFEGLLSGVNKYSTAFGRIWLSLVFIFRVLVYLVTAERVWSDDHKDFDCNTRQPGCSNVCFDEFFPVSHVRLWALQLILVTCPSLLVVMHVAYREVQEKRHREAHGENSGRLYLNPGKKRGGLWWTYVCSLVFKASVDIAFLYVFHSFYPKYILPPVVKCHADPCPNIVDCFISKPSEKNIFTLFMVATAAICILLNLVELIYLVSKRCHECLAARKAQAMCTGHHPHGTTSSCKQDDLLSGDLIFLGSDSHPPLLPDRPRDHVKKTIL

SEQ ID NO: 47362 - protein, 261 aa, Homo sapiens
MDWGTLHTFIGGVNKHSTSIGKVWITVIFIFRVMILVVAAQEVWGDEQEDFVCNTLQPGCKNVCYDHFFPVSHIRLWALQLIFVSTPALLVAMHVAYYRHETTRKFRRGEKRNDFKDIEDIKKQKVRIEGSLWWTYTSSIFFRIIFEAAFMYVFYFLYNGYHLPWVLKCGIDPCPNLVDCFISRPTEKTVFTIFMISASVICMLLNVAELCYLLLKVCFRRSKRAQTQKNHPNHALKESKQNEMNELISDSGQNAITGFPS

SEQ ID NO: 47363 - protein, 261 aa, Homo sapiens; identical to SEQ ID NO: 47362

SEQ ID NO: 47364 - protein, 261 aa, Homo sapiens; identical to SEQ ID NO: 47362

SEQ ID NO: 47365 - protein, 261 aa, Homo sapiens; identical to SEQ ID NO: 47362

SEQ ID NO: 47366 - protein, 223 aa, Homo sapiens
MSWMFLRDLLSGVNKYSTGTGWIWLAVVFVFRLLVYMVAAEHVWKDEQKEFECNSRQPGCKNVCFDDFFPISQVRLWALQLIMVSTPSLLVVLHVAYHEGREKRHRKKLYVSPGTMDGGLWYAYLISLIVKTGFEIGFLVLFYKLYDGFSVPYLIKCDLKPCPNTVDCFISKPTEKTIFILFLVITSCLCIVLNFIELSFLVLKCFIKCCLQKYLKKPQVLSV

SEQ ID NO: 47367 - protein, 163 aa, Homo sapiens
MSWMFLRDLLSGVNKYSTGTGWIWLAVVFVFRLLVYMVAAEHVWKDEQKEFECNSRQPGCKNVCFDDFFPISQVRLWALQLIMVSTPSLLVVLHVAYHEGREKRHRKKLYVSPGTMDGGLWYAYLISLIVKTGFEIGFLVLFYKLYDGFSVPYLIKCDLKPCP

SEQ ID NO: 47368 - protein, 223 aa, Homo sapiens; identical to SEQ ID NO: 47366

SEQ ID NO: 47369 - protein, 321 aa, Homo sapiens
MGEWTILERLLEAAVQQHSTMIGRILLTVVVIFRILIVAIVGETVYDDEQTMFVCNTLQPGCNQACYDRAFPISHIRYWVFQIIMVCTPSLCFITYSVHQSAKQRERRYSTVFLALDRDPPESIGGPGGTGGGGSGGGKREDKKLQNAIVNGVLQNTENTSKETEPDCLEVKELTPHPSGLRTASKSKLRRQEGISRFYIIQVVFRNALEIGFLVGQYFLYGFSVPGLYECNRYPCIKEVECYVSRPTEKTVFLVFMFAVSGICVVLNLAELNHLGWRKIKLAVRGAQAKRKSIYEIRNKDLPRVSVPNFGRTQSSDSAYV

SEQ ID NO: 47370 - protein, 296 aa, Homo sapiens
MGEWAFLGSLLDAVQLQSPLVGRLWLVVMLIFRILVLATVGGAVFEDEQEEFVCNTLQPGCRQTCYDRAFPVSHYRFWLFHILLLSAPPVLFVVYSMHRAGKEAGGAEAAAQCAPGLPEAQCAPCALRARRARRCYLLSVALRLLAELTFLGGQALLYGFRVAPHFACAGPPCPHTVDCFVSRPTEKTVFVLFYFAVGLLSALLSVAELGHLLWKGRPRAGERDNRCNRAHEEAQKLLPPPPPPPPIVVTWEENRHLQGEGSPGSPHPKTELDAPRFRRESTSPAGWHCSLPFHGT

SEQ ID NO: 47371 - protein, 370 aa, Homo sapiens
MEGVDLLGFLIITLNCNVTMVGKLWFVLTMLLRMLVIVLAGRPVYQDEQERFVCNTLQPGCANVCYDVFSPVSHLRFWLIQGVCVLLPSAVFSVYVLHRGATLAALGPRRCPDPREPASGQRRCPRPFGERGGLQVPDFSAGYIIHLLLRTLLEAAFGALHYFLFGFLAPKKFPCTRPPCTGVVDCYVSRPTEKSLLMLFLWAVSALSFLLGLADLVCSLRRRMRRRPGPPTSPSIRKQSGASGHAEGRRTDEEGGREEEGAPAPPGARAGGEGAGSPRRTSRVSGHTKIPDEDESEVTSSASEKLGRQPRGRPHREAAQDPRGSGSEEQPSAAPSRLAAPPSCSSLQPPDPPASSSGAPHLRARKSEWV

SEQ ID NO: 47372 - protein, 396 aa, Homo sapiens
MSWSFLTRLLEEIHNHSTFVGKIWLTVLIVFRIVLTAVGGESIYYDEQSKFVCNTEQPGCENVCYDAFAPLSHVRFWVFQIILVATPSVMYLGYAIHKIAKMEHGEADKKAARSKPYAMRWKQHRALEETEEDNEEDPMMYPEMELESDKENKEQSQPKPKHDGRRRIREDGLMKIYVLQLLARTVFEVGFLIGQYFLYGFQVHPFYVCSRLPCPHKIDCFISRPTEKTIFLLIMYGVTGLCLLLNIWEMLHLGFGTIRDSLNSKRRELEDPGAYNYPFTWNTPSAPPGYNIAVKPDQIQYTELSNAKIAYKQNKANTAQEQQYGSHEENLPADLEALQREIRMAQERLDLAVQAYSHQNNPHGPREKKAKVGSKAGSNKSTASSKSGDGKTSVWI

SEQ ID NO: 47373 - protein, 396 aa, Homo sapiens; identical to SEQ ID NO: 47372

SEQ ID NO: 47374 - protein, 439 aa, Homo sapiens
MTNMSWSFLTRLLEEIHNHSTFVGKVWLTVLVVFRIVLTAVGGEAIYSDEQAKFTCNTRQPGCDNVCYDAFAPLSHVRFWVFQIVVISTPSVMYLGYAVHRLARASEQERRRALRRRPGPRRAPRAHLPPPHAGWPEPADLGEEEPMLGLGEEEEEEETGAAEGAGEEAEEAGAEEACTKAVGADGKAAGTPGPTGQHDGRRRIQREGLMRVYVAQLVARAAFEVAFLVGQYLLYGFEVRPFFPCSRQPCPHVVDCFVSRPTEKTVFLLVMYVVSCLCLLLNLCEMAHLGLGSAQDAVRGRRGPPASAPAPAPRPPPCAFPAAAAGLACPPDYSLVVRAAERARAHDQNLANLALQALRDGAAAGDRDRDSSPCVGLPAASRGPPRAGAPASRTGSATSAGTVGEQGRPGTHERPGAKPRAGSEKGSASSRDGKTTVWI

SEQ ID NO: 47375 - protein, 279 aa, Homo sapiens
MCGRFLRRLLAEESRRSTPVGRLLLPVLLGFRLVLLAASGPGVYGDEQSEFVCHTQQPGCKAACFDAFHPLSPLRFWVFQVILVAVPSALYMGFTLYHVIWHWELSGKGKEEETLIQGREGNTDVPGAGSLRLLWAYVAQLGARLVLEGAALGLQYHLYGFQMPSSFACRREPCLGSITCNLSRPSEKTIFLKTMFGVSGFCLLFTFLELVLLGLGRWWRTWKHKSSSSKYFLTSESTRRHKKATDSLPVVETKEQFQEAVPGRSLAQEKQRPVGPRDA

SEQ ID NO: 47376 - protein, 445 aa, Homo sapiens
MTMFENVTRALARQLNPRGDLTPLDSLIDFKRFHPFCLVLRKRKSTLFWGARYVRTDYTLLDVLEPGSSPSDPTDTGNFGFKNMLDTRVEGDVDVPKTVKVKGTAGLSQNSTLEVQTLSVAPKALETVQERKLAADHPFLKEMQDQGENLYVVMEVVETVQEVTLERAGKAEACFSLPFFAPLGLQGSINHKEAVTIPKGCVLAFRVRQLMVKGKDEWDIPHICNDNMQTFPPGEKSGEEKVILIQASDVGDVHEGFRTLKEEVQRETQQVEKLSRVGQSSLLSSLSKLLGKKKELQDLELALEGALDKGHEVTLEALPKDVLLSKEAVGAILYFVGALTELSEAQQKLLVKSMEKKILPVQLKLVESTMEQNFLLDKEGVFPLQPELLSSLGDEELTLTEALVGLSGLEVQRSGPQYMWDPDTLPRLCALYAGLSLLQQLTKAS

SEQ ID NO: 47377 - protein, 403 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMKKDGASSCLGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 47378 - protein, 411 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMSAGLDIHFRGKTKSFPEGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 47379 - protein, 394 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMRKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 47380 - protein, 411 aa, Homo sapiens; identical to SEQ ID NO: 47378

SEQ ID NO: 47381 - protein, 416 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMNIHFRGKTKSFPEEKDGASSCLGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 47382 - protein, 348 aa, Homo sapiens
  MOD_RES (1)..(1): Any amino acid
XLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMNIHFRGKTKSFPEEKDGASSCLGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 47383 - protein, 407 aa, Homo sapiens
MFSVFEEITRIVVKEMDAGGDMIAVRSLVDADRFRCFHLVGEKRTFFGCRHYTTGLTLMDILDTDGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMNIHFRGKTKSFPEGKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 47384 - protein, 508 aa, Homo sapiens
MPSMLERISKNLVKEIGSKDLTPVKYLLSATKLRQFVILRKKKDSRSSFWEQSDYVPVEFSLNDILEPSSSVLETVVTGPFHFSDIMIQKHKADMGVNVGIEVSVSGEASVDHGCSLEFQIVTIPSPNLEDFQKRKLLDPEPSFLKECRRRGDNLYVVTEAVELINNTVLYDSSSVNILGKIALWITYGKGQGQGESLRVKKKALTLQKGMVMAYKRKQLVIKEKAILISDDDEQRTFQDEYEISEMVGYCAARSEGLLPSFHTISPTLFNASSNDMKLKPELFLTQQFLSGHLPKYEQVHILPVGRIEEPFWQNFKHLQEEVFQKIKTLAQLSKDVQDVMFYSILAMLRDRGALQDLMNMLELDSSGHLDGPGGAILKKLQQDSNHAWFNPKDPILYLLEAIMVLSDFQHDLLACSMEKRILLQQQELVRSILEPNFRYPWSIPFTLKPELLAPLQSEGLAITYGLLEECGLRMELDNPRSTWDVEAKMPLSALYGTLSLLQQLAEA

SEQ ID NO: 47385 - protein, 153 aa, Homo sapiens
MVATKTFALLLLSLFLAVGLGEKKEGHFSALPSLPVGSHAKVSSPQPRGPRYAEGTFISDYSIAMDKIHQQDFVNWLLAQKGKKNDWKHNITQREARALELASQANRKEEEAVEPQSSPAKNPSDEDLLRDLLIQELLACLLDQTNLCRLRSR

SEQ ID NO: 47386 - protein, 466 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 47387 - protein, 430 aa, Homo sapiens
MTTSPILQLLLRLSLCGLLLQRAETGSKGQTAGELYQRWERYRRECQETLAAAEPPSVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 47388 - protein, 466 aa, Homo sapiens; identical to SEQ ID NO: 47386

SEQ ID NO: 47389 - protein, 417 aa, Homo sapiens
MAWFALYLLSLLWATAGTSTQTQSSCSVPSAQEPLVNGIQVLMENSVTSSAYPNPSILIAMNLAGAYNLKAQKLLTYQLMSSDNNDLTIGQLGLTIMALTSSCRDPGDKVSILQRQMENWAPSSPNAEASAFYGPSLAILALCQKNSEATLPIAVRFAKTLLANSSPFNVDTGAMATLALTCMYNKIPVGSEEGYRSLFGQVLKDIVEKISMKIKDNGIIGDIYSTGLAMQALSVTPEPSKKEWNCKKTTDMILNEIKQGKFHNPMSIAQILPSLKGKTYLDVPQVTCSPDHEVQPTLPSNPGPGPTSASNITVIYTINNQLRGVELLFNETINVSVKSGSVLLVVLEEAQRKNPMFKFETTMTSWGLVVSSINNIAENVNHKTYWQFLSGVTPLNEGVADYIPFNHEHITANFTQY

SEQ ID NO: 47390 - protein, 392 aa, Homo sapiens
MAVPSAQEPLVNGIQVLMENSVTSSAYPNPSILIAMNLAGAYNLKAQKLLTYQLMSSDNNDLTIGQLGLTIMALTSSCRDPGDKVSILQRQMENWAPSSPNAEASAFYGPSLAILALCQKNSEATLPIAVRFAKTLLANSSPFNVDTGAMATLALTCMYNKIPVGSEEGYRSLFGQVLKDIVEKISMKIKDNGIIGDIYSTGLAMQALSVTPEPSKKEWNCKKTTDMILNEIKQGKFHNPMSIAQILPSLKGKTYLDVPQVTCSPDHEVQPTLPSNPGPGPTSASNITVIYTINNQLRGVELLFNETINVSVKSGSVLLVVLEEAQRKNPMFKFETTMTSWGLVVSSINNIAENVNHKTYWQFLSGVTPLNEGVADYIPFNHEHITANFTQY

SEQ ID NO: 47391 - protein, 101 aa, Homo sapiens
MQRLCVYVLIFALALAAFSEASWKPRSQQPDAPLGTGANRDLELPWLEQQGPASHHRRQLGPQGPPHLVADPSKKQGPWLEEEEEAYGWMDFGRRSAEDEN

SEQ ID NO: 47392 - protein, 148 aa, Homo sapiens
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 47393 - protein, 141 aa, Homo sapiens
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKGSQREGRNPQLNQQ

SEQ ID NO: 47394 - protein, 138 aa, Homo sapiens
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDLVDSLLQVLNVKEGTPS

SEQ ID NO: 47395 - protein, 384 aa, Homo sapiens
MALNDCFLLNLEVDHFMHCNISSHSADLPVNDDWSHPGILYVIPAVYGVIILIGLIGNITLIKIFCTVKSMRNVPNLFISSLALGDLLLLITCAPVDASRYLADRWLFGRIGCKLIPFIQLTSVGVSVFTLTALSADRYKAIVRPMDIQASHALMKICLKAAFIWIISMLLAIPEAVFSDLHPFHEESTNQTFISCAPYPHSNELHPKIHSMASFLVFYVIPLSIISVYYYFIAKNLIQSAYNLPVEGNIHVKKQIESRKRLAKTVLVFVGLFAFCWLPNHVIYLYRSYHYSEVDTSMLHFVTSICARLLAFTNSCVNPFALYLLSKSFRKQFNTQLLCCQPGLIIRSHSTGRSTTCMTSLKSTNPSVATFSLINGNICHERYV

SEQ ID NO: 47396 - protein, 159 aa, Homo sapiens
MASFLVFYVIPLSIISVYYYFIAKNLIQSAYNLPVEGNIHVKKQIESRKRLAKTVLVFVGLFAFCWLPNHVIYLYRSYHYSEVDTSMLHFVTSICARLLAFTNSCVNPFALYLLSEFQETVQHSAALLPAWPDHPVSQHWKEYNLHDLPQEYQPLRGHL

SEQ ID NO: 47397 - protein, 199 aa, Homo sapiens
MLAYSSVHCFREDKMKFTIVFAGLLGVFLAPALANYNINVNDDNNNAGSGQQSVSVNNEHNVANVDNNNGWDSWNSIWDYGNGFAATRLFQKKTCIVHKMNKEVMPSIQSLDALVKEKKLQGKGPGGPPPKGLMYSVNPNKVDDLSKFGKNIANMCRGIPTYMAEEMQEASLFFYSGTCYTTSVLWIVDISFCGDTVEN

SEQ ID NO: 47398 - protein, 363 aa, Homo sapiens
MQRAGGGSAPGGNGGGGGGGPGTAFSIDSLIGPPPPRSGHLLYTGYPMFMPYRPLVLPQALAPAPLPAGLPPLAPLASFAGRLTNTFCAGLGQAVPSMVALTTALPSFAEPPDAFYGPQELAAAAAAAAATAARNNPEPGGRRPEGGLEADELLPAREKVAEPPPPPPPHFSETFPSLPAEGKVYSSDEEKLEASAGDPAGSEQEEEGSGGDSEDDGFLDSSAGGPGALLGPKPKLKGSLGTGAEEGAPVTAGVTAPGGKSRRRRTAFTSEQLLELEKEFHCKKYLSLTERSQIAHALKLSEVQVKIWFQNRRAKWKRIKAGNVSSRSGEPVRNPKIVVPIPVHVNRFAVRSQHQQMEQGARP

SEQ ID NO: 47399 - protein, 348 aa, Homo sapiens
MSAAFPPSLMMMQRPLGSSTAFSIDSLIGSPPQPSPGHFVYTGYPMFMPYRPVVLPPPPPPPPALPQAALQPALPPAHPHHQIPSLPTGFCSSLAQGMALTSTLMATLPGGFSASPQHQEAAAARKFAPQPLPGGGNFDKAEALQADAEDGKGFLAKEGSLLAFSAAETVQASLVGAVRGQGKDESKVEDDPKGKEESFSLESDVDYSSDDNLTGQAAHKEEDPGHALEETPPSSGAAGSTTSTGKNRRRRTAFTSEQLLELEKEFHCKKYLSLTERSQIAHALKLSEVQVKIWFQNRRAKWKRVKAGNANSKTGEPSRNPKIVVPIPVHVSRFAIRSQHQQLEQARP

SEQ ID NO: 47400 - protein, 480 aa, Homo sapiens
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 47401 - protein, 466 aa, Homo sapiens
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 47402 - protein, 480 aa, Homo sapiens; identical to SEQ ID NO: 47400

SEQ ID NO: 47403 - protein, 150 aa, Homo sapiens
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGG

SEQ ID NO: 47404 - protein, 8 aa, Homo sapiens
MEVAPEQP

SEQ ID NO: 47405 - protein, 441 aa, Homo sapiens
MYQSLPWPPTTGRPPVPTRRAAPAPSCTARAPRPRQSTCPHRGALLRAGPVLPPGRRRGLCVRRASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLDMFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 47406 - protein, 442 aa, Homo sapiens
MYQSLAMAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLDMFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 47407 - protein, 175 aa, Homo sapiens
MFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVS

SEQ ID NO: 47408 - protein, 117 aa, Homo sapiens
MYQSLAMAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGSL

SEQ ID NO: 47409 - protein, 236 aa, Homo sapiens
MFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 47410 - protein, 443 aa, Homo sapiens
MYQSLAMAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLVDMFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 47411 - protein, 397 aa, Homo sapiens
MYQSLALAASPRQAAYADSGSFLHAPGAGSPMFVPPARVPSMLSYLSGCEPSPQPPELAARPGWAQTATADSSAFGPGSPHPPAAHPPGATAFPFAHSPSGPGSGGSAGGRDGSAYQGALLPREQFAAPLGRPVGTSYSATYPAYVSPDVAQSWTAGPFDGSVLHGLPGRRPTFVSDFLEEFPGEGRECVNCGALSTPLWRRDGTGHYLCNACGLYHKMNGVNRPLVRPQKRLSSSRRAGLCCTNCHTTNTTLWRRNSEGEPVCNACGLYMKLHGVPRPLAMKKESIQTRKRKPKTIAKARGSSGSTRNASASPSAVASTDSSAATSKAKPSLASPVCPGPSMAPQASGQEDDSLAPGHLEFKFEPEDFAFPSTAPSPQAGLRGALRQEAWCALALA

SEQ ID NO: 47412 - protein, 397 aa, Homo sapiens; identical to SEQ ID NO: 47411

SEQ ID NO: 47413 - protein, 417 aa, Homo sapiens
TATAVPCRPPCPLVKTTPGRMYQSLALAASPRQAAYADSGSFLHAPGAGSPMFVPPARVPSMLSYLSGCEPSPQPPELAARPGWAQTATADSSAFGPGSPHPPAAHPPGATAFPFAHSPSGPGSGGSAGGRDGSAYQGALLPREQFAAPLGRPVGTSYSATYPAYVSPDVAQSWTAGPFDGSVLHGLPGRRPTFVSDFLEEFPGEGRECVNCGALSTPLWRRDGTGHYLCNACGLYHKMNGVNRPLVRPQKRLSSSRRAGLCCTNCHTTNTTLWRRNSEGEPVCNACGLYMKLHGVPRPLAMKKESIQTRKRKPKTIAKARGSSGSTRNASASPSAVASTDSSAATSKAKPSLASPVCPGPSMAPQASGQEDDSLAPGHLEFKFEPEDFAFPSTAPSPQAGLRGALRQEAWCALALA

SEQ ID NO: 47414 - protein, 595 aa, Homo sapiens
MALTDGGWCLPKRFGAAGADASDSRAFPAREPSTPPSPISSSSSSCSRGGERGPGGASNCGTPQLDTEAAAGPPARSLLLSSYASHPFGAPHGPSAPGVAGPGGNLSSWEDLLLFTDLDQAATASKLLWSSRGAKLSPFAPEQPEEMYQTLAALSSQGPAAYDGAPGGFVHSAAAAAAAAAAASSPVYVPTTRVGSMLPGLPYHLQGSGSGPANHAGGAGAHPGWPQASADSPPYGSGGGAAGGGAAGPGGAGSAAAHVSARFPYSPSPPMANGAAREPGGYAAAGSGGAGGVSGGGSSLAAMGGREPQYSSLSAARPLNGTYHHHHHHHHHHPSPYSPYVGAPLTPAWPAGPFETPVLHSLQSRAGAPLPVPRGPSADLLEDLSESRECVNCGSIQTPLWRRDGTGHYLCNACGLYSKMNGLSRPLIKPQKRVPSSRRLGLSCANCHTTTTTLWRRNAEGEPVCNACGLYMKLHGVPRPLAMKKEGIQTRKRKPKNINKSKTCSGNSNNSIPMTPTSTSSNSDDCSKNTSPTTQPTASGAGAPVMTGAGESTNPENSELKYSGQDGLYIGVSLASPAEVTSSVRPDSWCALALA

SEQ ID NO: 47415 - protein, 2671 aa, Homo sapiens
MAADTQVSETLKRFAGKVTTASVKERREILSELGKCVAGKDLPEGAVKGLCKLFCLTLHRYRDAASRRALQAAIQQLAEAQPEATAKNLLHSLQSSGIGSKAGVPSKSSGSAALLALTWTCLLVRIVFPSRAKRQGDIWNKLVEVQCLLLLEVLGGSHKHAVDGAVKKLTKLWKENPGLVEQYLSAILSLEPNQNYAGMLGLLVQFCTSHKEMDVVSQHKSALLDFYMKNILMSKVKPPKYLLDSCAPLLRYLSHSEFKDLILPTIQKSLLRSPENVIETISSLLASVTLDLSQYAMDIVKGLAGHLKSNSPRLMDEAVLALRNLARQCSDSSAMESLTKHLFAILGGSEGKLTVVAQKMSVLSGIGSVSHHVVSGPSSQVLNGIVAELFIPFLQQEVHEGTLVHAVSVLALWCNRFTMEVPKKLTEWFKKAFSLKTSTSAVRHAYLQCMLASYRGDTLLQALDLLPLLIQTVEKAASQSTQVPTITEGVAAALLLLKLSVADSQAEAKLSSFWQLIVDEKKQVFTSEKFLVMASEDALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLVAVQSGLWPALLARMKIDPEAFITRHLDQIIPRMTTQSPLNQSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEYLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 47416 - protein, 480 aa, Homo sapiens
MAQHDFAPAWLNFPTPPSSTKVLTSSLKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 47417 - protein, 493 aa, Homo sapiens
MAQHDFAPAWLNFPTPPSSTKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWGLHAQTHTYPTKKISQAPLLEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 47418 - protein, 493 aa, Homo sapiens; identical to SEQ ID NO: 47417

SEQ ID NO: 47419 - protein, 473 aa, Homo sapiens
MAQHDFAPAWLNFPTPPSSTKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 47420 - protein, 465 aa, Homo sapiens
MAQHDFAPAWLNFPTPPSSTKVLTSSLKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKEQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 47421 - protein, 302 aa, Homo sapiens
MLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 47422 - protein, 480 aa, Homo sapiens
MAQHDFAPAWLNFPTPPSSTKVLSNTLKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 47423 - protein, 460 aa, Homo sapiens
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 47424 - protein, 460 aa, Homo sapiens; identical to SEQ ID NO: 47423

SEQ ID NO: 47425 - protein, 460 aa, Homo sapiens; identical to SEQ ID NO: 47423

SEQ ID NO: 47426 - protein, 465 aa, Homo sapiens
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISDVFQQVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 47427 - protein, 344 aa, Homo sapiens
MQEGKFWKGMAETGMWGCGEWIPVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 47428 - protein, 359 aa, Homo sapiens
MILANVFCLFFFLGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 47429 - protein, 464 aa, Homo sapiens
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 47430 - protein, 331 aa, Homo sapiens
MILANVFCLFFFLGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 47431 - protein, 265 aa, Homo sapiens
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCR

SEQ ID NO: 47432 - protein, 464 aa, Homo sapiens; identical to SEQ ID NO: 47429

SEQ ID NO: 47433 - protein, 400 aa, Homo sapiens
MVRPLNPRPLPPVVLMLLLLLPPSPLPLAAGDPLPTESRLMNSCLQARRKCQADPTCSAAYHHLDSCTSSISTPLPSEEPSVPADCLEAAQQLRNSSLIGCMCHRRMKNQVACLDIYWTVHRARSLGNYELDVSPYEDTVTSKPWKMNLSKLNMLKPDSDLCLKFAMLCTLNDKCDRLRKAYGEACSGPHCQRHVCLRQLLTFFEKAAEPHAQGLLLCPCAPNDRGCGERRRNTIAPNCALPPVAPNCLELRRLCFSDPLCRSRLVDFQTHCHPMDILGTCATEQSRCLRAYLGLIGTAMTPNFVSNVNTSVALSCTCRGSGNLQEECEMLEGFFSHNPCLTEAIAAKMRFHSQLFSQDWPHPTFAVMAHQNENPAVRPQPWVPSLFSCTLPLILLLSLW

SEQ ID NO: 47434 - protein, 369 aa, Homo sapiens
MVRPLNPRPLPPVVLMLLLLLPPSPLPLAAGDPLPTESRLMNSCLQARRKCQADPTCSAAYHHLDSCTSSISTPLPSEEPSVPADCLEAAQQLRNSSLIGCMCHRRMKNQVACLDIYWTVHRARSLDSDLCLKFAMLCTLNDKCDRLRKAYGEACSGPHCQRHVCLRQLLTFFEKAAEPHAQGLLLCPCAPNDRGCGERRRNTIAPNCALPPVAPNCLELRRLCFSDPLCRSRLVDFQTHCHPMDILGTCATEQSRCLRAYLGLIGTAMTPNFVSNVNTSVALSCTCRGSGNLQEECEMLEGFFSHNPCLTEAIAAKMRFHSQLFSQDWPHPTFAVMAHQNENPAVRPQPWVPSLFSCTLPLILLLSLW

SEQ ID NO: 47435 - protein, 711 aa, Homo sapiens
MESGAVLLESKSSPFNLLHEMHELRLLGHLCDVTVSVEYQGVRKDFMAHKAVLAATSKFFKEVFLNEKSVDGTRTNVYLNEVQVADFASFLEFVYTAKVQVEEDRVQRMLEVAEKLKCLDLSETCFQLKKQMLESVLLELQNFSESQEVEVSSGSQVSAAPAPRASVATDGPHPSGLTDSLDYPGERASNGMSSDLPPKKSKDKLDKKKEVVKPPYPKIRRASGRLAGRKVFVEIPKKKYTRRLREQQKTAEGDVGDYRCPQDQSPDRVGTEMEQVSKNEGCQAGAELEELSKKAGPEEEEEEEEEDEEGEKKKSNFKCSICEKAFLYEKSFLKHSKHRHGVATEVVYRCDTCGQTFANRCNLKSHQRHVHSSERHFPCELCGKKFKRKKDVKRHVLQVHEGGGERHRCGQCGKGLSSKTALRLHERTHTGDRPYGCTECGARFSQPSALKTHMRIHTGEKPFVCDECGARFTQNHMLIYHKRCHTGERPFMCETCGKSFASKEYLKHHNRIHTGSKPFKCEVCFRTFAQRNSLYQHIKVHTGERPYCCDQCGKQFTQLNALQRHRRIHTGERPFMCNACGRTFTDKSTLRRHTSIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 47436 - protein, 711 aa, Homo sapiens; identical to SEQ ID NO: 47435

SEQ ID NO: 47437 - protein, 48 aa, Homo sapiens
MESGAVLLESKSSPFNLLHEMHELRLLGHLCDVTVSVEYQGVRKDFMA

SEQ ID NO: 47438 - protein, 220 aa, Homo sapiens
MCETCGKSFASKEYLKHHNRIHTGSKPFKCEVCFRTFAQRNSLYQHIKVHTGERPYCCDQCGKQFTQLNALQRHRRIHTGERPFMCNACGRTFTDKSTLRRHTSIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 47439 - protein, 235 aa, Homo sapiens
MLIYHKRCHTGERPFMCETCGKSFASKEYLKHHNRIHTGSKPFKCEVCFRTFAQRNSLYQHIKVHTGERPYCCDQCGKQFTQLNALQRHRRIHTGERPFMCNACGRTFTDKSTLRRHTSIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 47440 - protein, 417 aa, Homo sapiens
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTETEALASNLMGMFENDPKTFEGVDPQTTSMRDVYRKFDLGQDVIDFTGHALALYRTDDYLDQPCLETVNRIKLYSESLARYGKSPYLYPLYGLGELPQGFARLSAIYGGTYMLNKPVDDIIMENGKVVGVKSEGEVARCKQLICDPSYIPDRVRKAGQVIRIICILSHPIKNTNDANSCQIIIPQNQVNRKSDIYVCMISYAHNVAAQGKYIAIASTTVETTDPEKEVEPALELLEPIDDGCESQVFCSCSYDATTHFETTCNDIKDIYKRMAGTAFDFENMKRKQNDVFGEAEQ

SEQ ID NO: 47441 - protein, 447 aa, Homo sapiens [sequence omitted]

SEQ ID NO: 47442 - protein, 148 aa, Homo sapiens
MSLGKRKPSNFYLANFLGKECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFL

SEQ ID NO: 47443 - protein, 449 aa, Homo sapiens [sequence omitted]

SEQ ID NO: 47444 - protein, 208 aa, Homo sapiens
MRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDLLASVTSWYQKTWEQKARSLFPAHMMPPLILRQRVMTLKTSIRG

SEQ ID NO: 47445 - protein, 400 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 47446 - protein, 445 aa, Homo sapiens
MNEEYDVIVLGTGLTECILSGIMSVNGKKVLHMDRNPYYGGESASITPLEDLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDIYVCMISFAHNVAAQGKYIAIVSTTVETKEPEKEIRPALELLEPIEQKFVSISDLLVPKDLGTESQIFISRTYDATTHFETTCDDIKNIYKRMTGSEFDFEEMKRKKNDIYGED

SEQ ID NO: 47447 - protein, 155 aa, Homo sapiens
MNEEYDVIVLGTGLTLYKRFKIPGSPPESMGRGRDWNVDLIPKFLMANGQLVKMLLYTEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALAL

SEQ ID NO: 47448 - protein, 203 aa, Homo sapiens
KKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGEIARCKQLICDPSYVKDRVEKVGQVIRVICILSHPIKNTNDANSCQIIIPQNQVNRKSDLLASVTSWYQKTWEQKARSLFPAHMMPPLILRQRVMTLKTSIRG

SEQ ID NO: 47449 - protein, 263 aa, Homo sapiens
MNEEYDVIVLGTGLTECILSGIMSVNGKKVLHMDRNPYYGGESASITPLEDLYKRFKIPGSPPESMGRGRDWNVDLIPKFLMANEVTRYLDFKVTEGSFVYKGGKIYKVPSTEAEALASSLMGLFEKRRFRKFLVYVANFDEKDPRTFEGIDPKKTTMRDVYKKFDLGQDVIDFTGHALALYRTDDYLDQPCYETINRIKLYSESLARYGKSPYLYPLYGLGELPQGFARLSAIYGGTYMLNKPIEEIIVQNGKVIGVKSEGE

SEQ ID NO: 47450 - protein, 372 aa, Homo sapiens
MAHAPARCPSARGSGDGEMGKPRNVALITGITGQDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVDFLQGDCTKAKQKLNWKPRVAFDELVREMVHADVELMRTNPNA

SEQ ID NO: 47451 - protein, 342 aa, Homo sapiens
MCKMDGSYLAEFLLEKGYEVHGIVRRSSSFNTGRIEHLYKNPQAHIEGNMKLHYGDLTDSTCLVKIINEVKPTEIYNLGAQSHVKISFDLAEYTADVDGVGTLRLLDAVKTCGLINSVKFYQASTSELYGKVQEIPQKETTPFYPRSPYGAAKLYAYWIVVNFREAYNLFAVNGILFNHESPRRGANFVTRKISRSVAKIYLGQLECFSLGNLDAKRDWGHAKDYVEAMWLMLQNDEPEDFVIATGEVHSVREFVEKSFLHIGKTIVWEGKNENEVGRCKETGKVHVTVDLKYYRPTEVDFLQGDCTKAKQKLNWKPRVAFDELVREMVHADVELMRTNPNA

SEQ ID NO: 47452 - protein, 731 aa, Homo sapiens
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 47453 - protein, 731 aa, Homo sapiens; identical to SEQ ID NO: 47452

SEQ ID NO: 47454 - protein, 782 aa, Homo sapiens
MAPHRPAPALLCALSLALCALSLPVRAATASRGASQAGAPQGRVPEARPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 47455 - protein, 731 aa, Homo sapiens; identical to SEQ ID NO: 47452

SEQ ID NO: 47456 - protein, 715 aa, Homo sapiens
MVVEHPEFLKAGKEPGLQIWRVEKFDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 47457 - protein, 742 aa, Homo sapiens
MEKLFCCFPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 47458 - protein, 731 aa, Homo sapiens; identical to SEQ ID NO: 47452

SEQ ID NO: 47459 - protein, 260 aa, Homo sapiens
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMS

SEQ ID NO: 47460 - protein, 742 aa, Homo sapiens; identical to SEQ ID NO: 47457

SEQ ID NO: 47461 - protein, 731 aa, Homo sapiens; identical to SEQ ID NO: 47452

SEQ ID NO: 47462 - protein, 705 aa, Homo sapiens
MVVEHPEFLKAGKEPGLQIWRVEKFDLVPVPTNLYGDFFTGDAYVILKTVQLRNGNLQYDLHYWLGNECSQDESGAAAIFTVQLDDYLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 47463 - protein, 739 aa, Homo sapiens
MPLCTPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 47464 - protein, 1508 aa, Homo sapiens
MGQEPRTLPPSPNWYCARCSDAVPGGLFGFAARTSVFLVRVGPGAGESPGTPPFRVIGELVGHTERVSGFTFSHHPGQYNLCATSSDDGTVKIWDVETKTVVTEHALHQHTISTLHWSPRVKDLIVSGDEKGVVFCYWFNRNDSQHLFIEPRTIFCLTCSPHHEDLVAIGYKDGIVVIIDISKKGEVIHRLRGHDDEIHSIAWCPLPGEDCLSINQEETSEEAEITNGNAVAQAPVTKGCYLATGSKDQTIRIWSCSRGRGVMILKLPFLKRRGGGIDPTVKERLWLTLHWPSNQPTQLVSSCFGGELLQWDLTQSWRRKYTLFSASSEGQNHSRIVFNLCPLQTEDDKQLLLSTSMDRDVKCWDIATLECSWTLPSLGGFAYSLAFSSVDIGSLAIGVGDGMIRVWNTLSIKNNYDVKNFWQGVKSKVTALCWHPTKEGCLAFGTDDGKVGLYDTYSNKPPQISSTYHKKTVYTLAWGPPVPPMSLGGEGDRPSLALYSCGGEGIVLQHNPWKLSGEAFDINKLIRDTNSIKYKLPVHTEISWKADGKIMALGNEDGSIEIFQIPNLKLICTIQQHHKLVNTISWHHEHGSQPELSYLMASGSNNAVIYVHNLKTVIESSPESPVTITEPYRTLSGHTAKITSVAWSPHHDGRLVSASYDGTAQVWDALREEPLCNFRGHRGRLLCVAWSPLDPDCIYSGADDFCVHKWLTSMQDHSRPPQGKKSIELEKKRLSQPKAKPKKKKKPTLRTPVKLESIDGNEEESMKENSGPVENGVSDQEGEEQAREPELPCGLAPAVSREPVICTPVSSGFEKSKVTINNKVILLKKEPPKEKPETLIKKRKARSLLPLSTSLDHRSKEELHQDCLVLATAKHSRELNEDVSADVEERFHLGLFTDRATLYRMIDIEGKGHLENGHPELFHQLMLWKGDLKGVLQTAAERGELTDNLVAMAPAAGYHVWLWAVEAFAKQLCFQDQYVKAASHLLSIHKVYEAVELLKSNHFYREAIAIAKARLRPEDPVLKDLYLSWGTVLERDGHYAVAAKCYLGATCAYDAAKVLAKKGDAASLRTAAELAAIVGEDELSASLALRCAQELLLANNWVGAQEALQLHESLQGQRLVFCLLELLSRHLEEKQLSEGKSSSSYHTWNTGTEGPFVERVTAVWKSIFSLDTPEQYQEAFQKLQNIKYPSATNNTPAKQLLLHICHDLTLAVLSQQMASWDEAVQALLRAVVRSYDSGSFTIMQEVYSAFLPDGCDHLRDKLGDHQSPATPAFKSLEAFFLYGRLYEFWWSLSRPCPNSSVWVRAGHRTLSVEPSQQLDTASTEETDPETSQPEPNRPSELDLRLTEEGERMLSTFKELFSEKHASLQNSQRTVAEVQETLAEMIRQHQKSQLCKSTANGPDKNEPEVEAEQPLCSSQSQCKEEKNEPLSLPELTKRLTEANQRMAKFPESIKAWPFPDVLECCLVLLLIRSHFPGCLAQEMQQQAQELLQKYGNTKTYRRHCQTFCM

SEQ ID NO: 47465 - protein, 131 aa, Homo sapiens
MQTPVNIPVPVLRLPRGPDGFSRGFAPDGRRAPLRPEVPEIQECPIAQESLESQEQRARAALRERYLRSLLAMVGHQVSFTLHEGVRVAAHFGATDLDVANFYVSQLQTPIGVQAEALLRCSDIISYTFKP

SEQ ID NO: 47466 - protein, 131 aa, Homo sapiens; identical to SEQ ID NO: 47465

SEQ ID NO: 47467 - protein, 970 aa, Homo sapiens
MDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPGAGTRQLVKASSTGTESSDDFEERDPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPEVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEIPTPQSDQREDVAEDTKDGGGEVSSQGPEDSLLGTQSRGHFSRQPVKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 47468 - protein, 941 aa, Homo sapiens
MDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGPTPGSDVDSVGGGSESRSLDSPTSSPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPEVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDSSPAPGPLTTSSQPPPPHLDPDSQPPVLASDPGPDPQHHSTLEQHPTATPTEIPTPQSDQREDVAEDTKDGGGEVSSQGPEDSLLGTQSRGHFSRQPVKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 47469 - protein, 334 aa, Homo sapiens
MNTILPCQDQYFVGGQSYNCPYSTTTSESSVDVSTETWVSFWAAGLLDNRELQQAPQAQESFSDSNFPLPDLCSWEEAQLSSQLYRNKQLQDTLVQKEEELARLHEENNHLRQYLNSALVKCLEEKAKKLLSSDEFSKAYGKFRKGKRKSKEQRYSPAEIPHPKNAKRNLSSEFANCEEQAGPPVDPWVLQTLGLKDLDTIDDTSSANYSALASHPRRVASTFSQFPDDAVDYKNIPREDMPIDYRGDRTTPLHSTATHGEDFHILSQLSNPPVGLKTLPYYTAHVSPNKTEMAFSTSLSPHCNVKTHSFHQGQAFVRRDEEGGWKFTWVPKQS

SEQ ID NO: 47470 - protein, 908 aa, Homo sapiens
MGVNDLWQILEPVKQHIPLRNLGGKTIAVDLSLWVCEAQTVKKMMGSVMKPHLRNLFFRISYLTQMDVKLVFVMEGEPPKLKADVISKRNQSRYGSSGKSWSQKTGRSHFKSVLRECLHMLECLGIPWVQAAGEAEAMCAYLNAGGHVDGCLTNDGDTFLYGAQTVYRNFTMNTKDPHVDCYTMSSIKSKLGLDRDALVGLAILLGCDYLPKGVPGVGKEQALKLIQILKGQSLLQRFNRWNETSCNSSPQLLVTKKLAHCSVCSHPGSPKDHERNGCRLCKSDKYCEPHDYEYCCPCEWHRTEHDRQLSEVENNIKKKACCCEGFPFHEVIQEFLLNKDKLVKVIRYQRPDLLLFQRFTLEKMEWPNHYACEKLLVLLTHYDMIERKLGSRNSNQLQPIRIVKTRIRNGVHCFEIEWEKPEHYAMEDKQHGEFALLTIEEESLFEAAYPEIVAVYQKQKLEIKGKKQKRIKPKENNLPEPDEVMSFQSHMTLKPTCEIFHKQNSKLNSGISPDPTLPQESISASLNSLLLPKNTPCLNAQEQFMSSLRPLAIQQIKAVSKSLISESSQPNTSSHNISVIADLHLSTIDWEGTSFSNSPAIQRNTFSHDLKSEVESELSAIPDGFENIPEQLSCESERYTANIKKVLDEDSDGISPEEHLLSGITDLCLQDLPLKERIFTKLSYPQDNLQPDVNLKTLSILSVKESCIANSGSDCTSHLSKDLPGIPLQNESRDSKILKGDQLLQEDYKVNTSVPYSVSNTVVKTCNVRPPNTALDHSRKVDMQTTRKILMKKSVCLDRHSSDEQSAPVFGKAKYTTQRMKHSSQKHNSSHFKESGHNKLSSPKIHIKETEQCVRSYETAENEESCFPDSTKSSLSSLQCHKKENNSGTCLDSPLPLRQRLKLRFQST

SEQ ID NO: 47471 - protein, 908 aa, Homo sapiens; identical to SEQ ID NO: 47470

SEQ ID NO: 47472 - protein, 126 aa, Homo sapiens
MGVNDLWQILEPVKQHIPLRNLGGKTIAVDLSLWVCEAQTVKKMMGSVMKPHLRNLFFRISYLTQMDVKLVFVMEGEPPKLKADVISKRNQSRYGSSGKSWSQKTGRSHFKSVLRECLHMLECLGI

SEQ ID NO: 47473 - protein, 93 aa, Homo sapiens
MGVNDLWQILEPVKQHIPLRNLGGKTIAVDLSLWVCEAQTVKKMMGSVMKPHLRNLFFRISYLTQMDVKLVFVMEGEPPKLKADVISKRNQSR

SEQ ID NO: 47474 - protein, 476 aa, Homo sapiens
MEWPNHYACEKLLVLLTHYDMIERKLGSRNSNQLQPIRIVKTRIRNGVHCFEIEWEKPEHYAMEDKQHGEFALLTIEEESLFEAAYPEIVAVYQKQKLEIKGKKQKRIKPKENNLPEPDEVMSFQSHMTLKPTCEIFHKQNSKLNSGISPDPTLPQESISASLNSLLLPKNTPCLNAQEQFMSSLRPLAIQQIKAVSKSLISESSQPNTSSHNISVIADLHLSTIDWEGTSFSNSPAIQRNTFSHDLKSEVESELSAIPDGFENIPEQLSCESERYTANIKKVLDEDSDGISPEEHLLSGITDLCLQDLPLKERIFTKLSYPQDNLQPDVNLKTLSILSVKESCIANSGSDCTSHLSKDLPGIPLQNESRDSKILKGDQLLQEDYKVNTSVPYSVSNTVVKTCNVRPPNTALDHSRKVDMQTTRKILMKKSVCLDRHSSDEQSAPVFGKAKYTTQRMKHSSQKHNSSHFKESGHNE

SEQ ID NO: 47475 - protein, 478 aa, Homo sapiens
MACLNPVPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 47476 - protein, 444 aa, Homo sapiens
MACLNPVLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 47477 - protein, 316 aa, Homo sapiens
MASTSRLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIARKAVELDLVPGRSPISVAAAAIYMASQASAEKRTQKEIGDIAGVADVTIRQSYRLIYPRAPDLFPTDFKFDTPVDKLPQL

SEQ ID NO: 47478 - protein, 231 aa, Homo sapiens
MASTSRLDALPRVTCPNHPDAILVEDYRAGDMICPECDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIA

SEQ ID NO: 47479 - protein, 224 aa, Homo sapiens
ASTSRLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRNWRYCWCC

SEQ ID NO: 47480 - protein, 291 aa, Homo sapiens
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKKKILFFNDKSCQFSVDEEFQKLWRSVTVDSMDEEKIEEYLKRQGISSMQESGPKKVAPIQRRKKPASQKKRRFKTHNEHLAGVLKDYSDITSSK

SEQ ID NO: 47481 - protein, 126 aa, Homo sapiens
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVN

SEQ ID NO: 47482 - protein, 198 aa, Homo sapiens
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKK

SEQ ID NO: 47483 - protein, 517 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDKEEEEEKKAPTPQEKKRRKDSSEESDSSEESDIDSEASSALFMAKKKTPPKRERKPSGGSSRGNSRPGTPSAEGGSTSSTLRAAASKLEQGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 47484 - protein, 432 aa, Homo sapiens
MAFNAADKVNFATWNQARLERDLSNKKIYQEEEMPESGAGSEFNRKLREEARRKKYGIVLKEFRPEDQPWLLRVNGKSGRKRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDKEEEEEKKAPTPQEKKRRKDSSEESDSSEESDIDSEASSALFMAKKKTPPKRERKPSGGSSRGNSRPGTPSAEGGSTSSTLRAAASKLEQGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 47485 - protein, 127 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIF

SEQ ID NO: 47486 - protein, 548 aa, Homo sapiens
MATSSEEVLLIVKKVRQKKQDGALYLMAERIAWAPEGKDRFTISHMYADIKCQKISPEGKAKIQLQLVLHAGDTTNFHFSNESTAVKERDAVKDLLQQLLPKFKRKANKELEEKNRMLQEDPVLFQLYKDLVVSQVISAEEFWANRLNVNATDSSSTSNHKQDVGISAAFLADVRPQTDGCNGLRYNLTSDIIESIFRTYPAVKMKYAENVPHNMTEKEFWTRFFQSHYFHRDRLNTGSKDLFAECAKIDEKGLKTMVSLGVKNPLLDLTALEDKPLDEGYGISSVPSASNSKSIKENSNAAIIKRFNHHSAMVLAAGLRKQEAQNEQTSEPSNMDGNSGDADCFQPAVKRAKLQESIEYEDLGKNNSVKTIALNLKKSDRYYHGPTPIQSLQYATSQDIINSFQSIRQEMEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 47487 - protein, 548 aa, Homo sapiens; identical to SEQ ID NO: 47486

SEQ ID NO: 47488 - protein, 95 aa, Homo sapiens
MATSSEEVLLIVKKVRQKKQDGALYLMAERIAWAPEGKDRFTISHMYADIKCQKISPEGKAKIQLQLVLHAGDTTNFHFSNESTAVKERDAVKDL

SEQ ID NO: 47489 - protein, 432 aa, Homo sapiens
MLQEDPVLFQLYKDLVVSQVISAEEFWANRLNVNATDSSSTSNHKQDVGISAAFLADVRPQTDGCNGLRYNLTSDIIESIFRTYPAVKMKYAENVPHNMTEKEFWTRFFQSHYFHRDRLNTGSKDLFAECAKIDEKGLKTMVSLGVKNPLLDLTALEDKPLDEGYGISSVPSASNSKSIKENSNAAIIKRFNHHSAMVLAAGLRKQEAQNEQTSEPSNMDGNSGDADCFQPAVKRAKLQESIEYEDLGKNNSVKTIALNLKKSDRYYHGPTPIQSLQYATSQDIINSFQSIRQEMEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 47490 - protein, 395 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSIAMQTLKHMPGHTSREVLIIFSSLTTCDPSNIYDLIKTLKAAKIRVSVIGLSAEVRVCTVLARETGGTYHVILDESHYKELLTHHVSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 47491 - protein, 395 aa, Homo sapiens; identical to SEQ ID NO: 47490

SEQ ID NO: 47492 - protein, 338 aa, Homo sapiens
MRHLYVVVDGSRTMEDQDLKPNRLTCTLKLLEYFVEEYFDQNPISQIGIIVTKSKRAEKLTELSGNPRKHITSLKKAVDMTCHGEPSLYNSLSIAMQTLKHMPGHTSREVLIIFSSLTTCDPSNIYDLIKTLKAAKIRVSVIGLSAEVRVCTVLARETGGTYHVILDESHYKELLTHHVSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 47493 - protein, 395 aa, Homo sapiens; identical to SEQ ID NO: 47490

SEQ ID NO: 47494 - protein, 462 aa, Homo sapiens
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGGKAWSDDTSQLGPDKHARDVPSLDKYAEERWEVVLHFMVGSPSAAVSQDLAQLLSQAGLMKSTEPGEPPCITSAGFQFLLLDTPAQLWYFMLQYLQTAQSRGMDLVEILSFLFQLSFSTLGKDYSVEGMSDSLLNFLQHLREFGLVFQRKRKSRRYYPTRLAINLSSGVSGAGGTVHQPGFIVVETNYRLYAYTESELQIALIALFSEMLYRFPNMVVAQVTRESVQQAIASGITAQQIIHFLRTRAHPVMLKQTPVLPPTITDQIRLWELERDRLRFTEGVLYNQFLSQVDFELLLAHARELGVLVFENSAKRLMVVTPAGHSDVKRFWKRQKHSS

SEQ ID NO: 47495 - protein, 462 aa, Homo sapiens; identical to SEQ ID NO: 47494

SEQ ID NO: 47496 - protein, 462 aa, Homo sapiens; identical to SEQ ID NO: 47494

SEQ ID NO: 47497 - protein, 462 aa, Homo sapiens; identical to SEQ ID NO: 47494

SEQ ID NO: 47498 - protein, 462 aa, Homo sapiens; identical to SEQ ID NO: 47494

SEQ ID NO: 47499 - protein, 138 aa, Homo sapiens
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGTGITGVSHCAWPG

SEQ ID NO: 47500 - protein, 462 aa, Homo sapiens; identical to SEQ ID NO: 47494

SEQ ID NO: 47501 - protein, 138 aa, Homo sapiens; identical to SEQ ID NO: 47499

SEQ ID NO: 47502 - protein, 462 aa, Homo sapiens; identical to SEQ ID NO: 47494

SEQ ID NO: 47503 - protein, 138 aa, Homo sapiens; identical to SEQ ID NO: 47499

SEQ ID NO: 47504 - protein, 462 aa, Homo sapiens; identical to SEQ ID NO: 47494

SEQ ID NO: 47505 - protein, 462 aa, Homo sapiens; identical to SEQ ID NO: 47494

SEQ ID NO: 47506 - protein, 462 aa, Homo sapiens; identical to SEQ ID NO: 47494

SEQ ID NO: 47507 - protein, 462 aa, Homo sapiens; identical to SEQ ID NO: 47494

SEQ ID NO: 47508 - protein, 138 aa, Homo sapiens; identical to SEQ ID NO: 47499

SEQ ID NO: 47509 - protein, 138 aa, Homo sapiens; identical to SEQ ID NO: 47499

SEQ ID NO: 47510 - protein, 138 aa, Homo sapiens; identical to SEQ ID NO: 47499

SEQ ID NO: 47511 - protein, 462 aa, Homo sapiens; identical to SEQ ID NO: 47494

SEQ ID NO: 47512 - protein, 220 aa, Homo sapiens
MRMLFLEQPLPQAAVALWVKKEFSKAQEESTGLLSGLRIWHTQLLPGGLQGLILNPIFRQNLRIALLGGGKAWSDDTSQLGPDKHARDVPSLDKYAEERWEVVLHFMVGSPSAAVSQDLAQLLSQAGLMKSTEPGEPPCITSAGFQFLLLDTPAQLWYFMLQYLQTAQSRGMDLVEILSFLFQLSFSTLGKDYSVEGMSDSLLNFLQHLREFGLVFQRKV

SEQ ID NO: 47513 - protein, 220 aa, Homo sapiens; identical to SEQ ID NO: 47512

SEQ ID NO: 47514 - protein, 220 aa, Homo sapiens; identical to SEQ ID NO: 47512

SEQ ID NO: 47515 - protein, 220 aa, Homo sapiens; identical to SEQ ID NO: 47512

SEQ ID NO: 47516 - protein, 220 aa, Homo sapiens; identical to SEQ ID NO: 47512

SEQ ID NO: 47517 - protein, 220 aa, Homo sapiens; identical to SEQ ID NO: 47512

SEQ ID NO: 47518 - protein, 71 aa, Homo sapiens
MVNVLKGVLIECDPAMKQFLLYLDESNALGKKFIIQDIDDTHVFVIAELVNVLQERVGELMDQNAFSLTQK

SEQ ID NO: 47519 - protein, 998 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQAGPSETDDVDEKQPLSKPLQGSHHSSEGNEGTEMEVPAEDSTQHVPSETSEDPEVEVTIEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 47520 - protein, 977 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQAGPSETDDVDEKQPLSKPLQGSHHSSEGNEGTEMEVPAEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 47521 - protein, 978 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEDSTQHVPSETSEDPEVEVTIEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 47522 - protein, 957 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 47523 - protein, 106 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDA

SEQ ID NO: 47524 - protein, 274 aa, Homo sapiens
MAQVAMSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQGSHHSSEGNEGTEMEVPAEG

SEQ ID NO: 47525 - protein, 993 aa, Homo sapiens
MSTLPVEDEESSESRMVVTFLMSALESMCKELAKSKAEVACIAVYETDVFVVGTERGRAFVNTRKDFQKDFVKYCVEEEEKAAEMHKMKSTTQANRMSVDAVEIETLRKTVEDYFCFCYGKALGKSTVVPVPYEKMLRDQSAVVVQGLPEGVAFKHPENYDLATLKWILENKAGISFIIKRPFLEPKKHVGGRVMVTDADRSILSPGGSCGPIKVKTEPTEDSGISLEMAAVTVKEESEDPDYYQYNIQAGPSETDDVDEKQPLSKPLQGSHHSSEGNEGTEMEVPAEDSTQHVPSETSEDPEVEVTIEDDDYSPPSKRPKANELPQPPVPEPANAGKRKVREFNFEKWNARITDLRKQVEELFERKYAQAIKAKGPVTIPYPLFQSHVEDLYVEGLPEGIPFRRPSTYGIPRLERILLAKERIRFVIKKHELLNSTREDLQLDKPASGVKEEWYARITKLRKMVDQLFCKKFAEALGSTEAKAVPYQKFEAHPNDLYVEGLPENIPFRSPSWYGIPRLEKIIQVGNRIKFVIKRPELLTHSTTEVTQPRTNTPVKEDWNVRITKLRKQVEEIFNLKFAQALGLTEAVKVPYPVFESNPEFLYVEGLPEGIPFRSPTWFGIPRLERIVRGSNKIKFVVKKPELVISYLPPGMASKINTKALQSPKRPRSPGSNSKVPEIEVTVEGPNNNNPQTSAVRTPTQTNGSNVPFKPRGREFSFEAWNAKITDLKQKVENLFNEKCGEALGLKQAVKVPFALFESFPEDFYVEGLPEGVPFRRPSTFGIPRLEKILRNKAKIKFIIKKPEMFETAIKESTSSKSPPRKINSSPNVNTTASGVEDLNIIQVTIPDDDNERLSKVEKARQLREQVNDLFSRKFGEAIGMGFPVKVPYRKITINPGCVVVDGMPPGVSFKAPSYLEISSMRRILDSAEFIKFTVIRPFPGLVINNQLVDQSESEGPVIQESAEPSQLEVPATEEIKETDGSSQIKQEPDPTW

SEQ ID NO: 47526 - protein, 213 aa, Homo sapiens
MAAAADERSPEDGEDEEEEEQLVLVELSGIIDSDFLSKCENKCKVLGIDTERPILQVDSCVFAGEYEDTLGTCVIFEENVEHADTEGNNKTVLKYKCHTMKKLSMTRTLLTEKKEGEENIGGVEWLQIKDNDFSYRPNMICNFLHENEDEEVVASAPDKSLELEEEEIQMNDSSNLSCEQEKPMHLEIEDSGPLIDIPSETEGSVFMETQMLP

SEQ ID NO: 47527 - protein, 705 aa, Homo sapiens
MATEGMILTNHDHQIRVGVLTVSDSCFRNLAEDRSGINLKDLVQDPSLLGGTISAYKIVPDEIEEIKATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 47528 - protein, 736 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 47529 - protein, 769 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 47530 - protein, 300 aa, Homo sapiens [sequence omitted]

SEQ ID NO: 47531 - protein, 300 aa, Homo sapiens [sequence omitted]

SEQ ID NO: 47532 - protein, 242 aa, Homo sapiens
MEKTQETVQRILLEPYKYLLQLPGKQVRTKLSQAFNHWLKVPEDKLQIIIEVTEMLHNASLLIDDIEDNSKLRRGFPVAHSIYGIPSVINSANYVYFLGLEKVLTLDHPDAVKLFTRQLLELHQGQGLDIYWRDNYTCPTEEEYKAMVLQKTGGLFGLAVGLMQLFSDYKEDLKPLLNTLGLFFQIRDDYANLHSKEYSENKSFCEDLTEGKFSFPTIHAIWSRPESTQVQNILRQRTENID

SEQ ID NO: 47533 - protein, 300 aa, Homo sapiens [sequence omitted]

SEQ ID NO: 47534 - protein, 300 aa, Homo sapiens [sequence omitted]

SEQ ID NO: 47535 - protein, 230 aa, Homo sapiens
MEKTQETVQRILLEPYKYLLQLPGKQVRTKLSQAFNHWLKVPEDKLQIIIEVTEMLHNASLLIDDIEDNSKLRRGFPVAHSIYGIPSVINSANYVYFLGLEKVLTLDHPDAVKLFTRQLLELHQGQGLDIYWRDNYTCPTEEEYKAMVLQKTGGLFGLAVGLMQLFSDYKEDLKPLLNTLGLFFQIRDDYANLHSKEYSENKSFCEDLTEGKFSFPTIHAIWSRPESTQV

SEQ ID NO: 47536 - protein, 178 aa, Homo sapiens
MGNSLLRENRRQQNTQEMPWNVRMQSPKQRTSRCWDHHIAEGCFCLPWKKILIFEKRQDSQNENERMSSTPIQDNVDQTYSEELCYTLINHRVLCTRPSGNSAEEYYENVPCKAERPRESLGGTETEYSLLHMPSTDPRHARSPEDEYELLMPHRISSHFLQQPRPLMAPSETQFSHL

SEQ ID NO: 47537 - protein, 163 aa, Homo sapiens
MGNSLLRENRRQQNTQEMPWNVRMQSPKQRTSRKKILIFEKRQDSQNENERMSSTPIQDNVDQTYSEELCYTLINHRVLCTRPSGNSAEEYYENVPCKAERPRESLGGTETEYSLLHMPSTDPRHARSPEDEYELLMPHRISSHFLQQPRPLMAPSETQFSHL

SEQ ID NO: 47538 - protein, 180 aa, Homo sapiens
MGNSLLRENSFRRQQNTQEMPWNVRMQSPKQRTSRCWDHHIAEGCFCLPWKKILIFEKRQDSQNENERMSSTPIQDNVDQTYSEELCYTLINHRVLCTRPSGNSAEEYYENVPCKAERPRESLGGTETEYSLLHMPSTDPRHARSPEDEYELLMPHRISSHFLQQPRPLMAPSETQFSHL

SEQ ID NO: 47539 - protein, 116 aa, Homo sapiens
MPSPGTVCSLLLLGMLWLDLAMAGSSFLSPEHQRVQRKESKKPPAKLQPRALAGWLRPEDGGQAEGAEDELEVRFNAPFDVGIKLSGVQYQQHSQALGKFLQDILWEEAKEAPADK

SEQ ID NO: 47540 - protein, 117 aa, Homo sapiens
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 47541 - protein, 91 aa, Homo sapiens
MPSPGTVCSLLLLGMLWLDLAMAGSSFLSPEHQRVQQRKESKKPPAKLQPRALAGWLRPEDGGQAEGAEDELEVRRPQPTSDRPQALLTSL

SEQ ID NO: 47542 - protein, 33 aa, Homo sapiens
MPSPGTVCSLLLLGMLWLDLAMAGSSFLSPEHQ

SEQ ID NO: 47543 - protein, 117 aa, Homo sapiens; identical to SEQ ID NO: 47540

SEQ ID NO: 47544 - protein, 116 aa, Homo sapiens; identical to SEQ ID NO: 47539

SEQ ID NO: 47545 - protein, 105 aa, Homo sapiens
MFTCWWSYLRSTLAAVPGEASRVQQRKESKKPPAKLQPRALAGWLRPEDGGQAEGAEDELEVRFNAPFDVGIKLSGVQYQQHSQALGKFLQDILWEEAKEAPADK

SEQ ID NO: 47546 - protein, 66 aa, Homo sapiens
MFTCWWSYLRSTLAAVPGEASRVQFNAPFDVGIKLSGVQYQQHSQALGKFLQDILWEEAKEAPADK

SEQ ID NO: 47547 - protein, 104 aa, Homo sapiens
MFTCWWSYLRSTLAAVPGEASRVQRKESKKPPAKLQPRALAGWLRPEDGGQAEGAEDELEVRFNAPFDVGIKLSGVQYQQHSQALGKFLQDILWEEAKEAPADK

SEQ ID NO: 47548 - protein, 116 aa, Homo sapiens; identical to SEQ ID NO: 47539

SEQ ID NO: 47549 - protein, 117 aa, Homo sapiens; identical to SEQ ID NO: 47540

SEQ ID NO: 47550 - protein, 117 aa, Homo sapiens; identical to SEQ ID NO: 47540

SEQ ID NO: 47551 - protein, 597 aa, Homo sapiens
MAEGSAVSDPQHAARLLRALSSFREESRFCDAHLVLDGEEIPVQKNILAAASPYIRTKLNYNPPKDDGSTYKIELEGISVMVMREILDYIFSGQIRLNEDTIQDVVQAADLLLLTDLKTLCCEFLEGCIAAENCIGIRDFALHYCLHHVHYLATEYLETHFRDVSSTEEFLELSPQKLKEVISLEKLNVGNERYVFEAVIRWIAHDTEIRKVHMKDVMSALWVSGLDSSYLREQMLNEPLVREIVKECSNIPLSQPQQGEAMLANFKPRGYSECIVTVGGEERVSRKPTAAMRCMCPLYDPNRQLWIELAPLSMPRINHGVLSAEGFLFVFGGQDENKQTLSSGEKYDPDANTWTALPPMNEARHNFGIVEIDGMLYILGGEDGEKELISMECYDIYSKTWTKQPDLTMVRKIGCYAAMKKKIYAMGGGSYGKLFESVECYDPRTQQWTAICPLKERRFGAVACGVAMELYVFGGVRSREDAQGSEMVTCKSEFYHDEFKRWIYLNDQNLCIPASSSFVYGAVPIGASIYVIGDLDTGTNYDYVREFKRSTGTWHHTKPLLPSDLRRTGCAALRIANCKLFRLQLQQGLFRIRVHSP

SEQ ID NO: 47552 - protein, 196 aa, Homo sapiens
MFCEKAMELIRELHRAPEGQLPAFNEDGLRQVLEEMKALYEQNQSDVNEAKSGGRSDLIPTIKFRHCSLLRNRRCTVAYLYDRLLRIRALRWEYGSVLPNALRFHMAAEEMEWFNNYKRSLATYMRSLGGDEGLDITQDMKPPKSLYIEVRCLKDYGEFEVDDGTSVLLKKNSQHFLPRWKCEQLIRQGVLEHILS

SEQ ID NO: 47553 - protein, 165 aa, Homo sapiens
MFCEKAMELIRELHRAPEGQLPAFNEDGLRQVLEEMKALYEQNQSDVNEAKSGGRSDLIPTIKFRHCSLLRNRRCTVAYLYDRLLRIRALRWEYGSVLPNALRFHMAAEEMESRSVAQAGVQWCILCSLQLPPPGFKQFSCLSLPSSCDYRWSGLIIIKDLLLLI

SEQ ID NO: 47554 - protein, 185 aa, Homo sapiens
MDAAEVEFLAEKELVTIIPNFSLDKIYLIGGDLGPFNPGLPVEVPLWLAINLKQRQKCRLLPPEWMDVEKLEKMRDHERKEETFTPMPSPYYMELTKLLLNHASDNIPKADEIRTLVKDMWDTRIAKLRVSADSFVRQQEAHAKLDNLTLMEINTSGTFLTQALNHMYKLRTNLQPLESTQSQDF

SEQ ID NO: 47555 - protein, 216 aa, Homo sapiens
MSEAYFRVESGALGPEENFLSLDDILMSHEKLPVRTETAMPRLGAFFLERSAGAETDNAVPQGSKLELPLWLAKGLFDNKRRILSVELPKIYQEGWRTVFSADPNVVDLHKMGPHFYGFGSQLLHFDSPENADISQSLLQTFIGRFRRIMDSSQNAYNEDTSALVARLDEMERGLFQTGQKGLNDFQCWEKGQASQITASNLVQNYKKRKFTDMED

SEQ ID NO: 47556 - protein, 138 aa, Homo sapiens
MSEAYFRVESGALGPEENFLSLDDILMSHEKLPVRTETAMPRLGAFFLERSAGAETDNAVPQTFIGRFRRIMDSSQNAYNEDTSALVARLDEMERGLFQTGQKGLNDFQCWEKGQASQITASNLVQNYKKRKFTDMED

SEQ ID NO: 47557 - protein, 255 aa, Homo sapiens
MSEAYFRVESGALGPEENFLSLDDILMSHEKLPVRTETAMPRLGAFFLERSAGAETDNAVPQGFALLPRLECSGVIWLTAALTSQAPEILPPQPPMWLVLQGSKLELPLWLAKGLFDNKRRILSVELPKIYQEGWRTVFSADPNVVDLHKMGPHFYGFGSQLLHFDSPENADISQSLLQTFIGRFRRIMDSSQNAYNEDTSALVARLDEMERGLFQTGQKGLNDFQCWEKGQASQITASNLVQNYKKRKFTDMED

SEQ ID NO: 47558 - protein, 223 aa, Homo sapiens
MTEEVDFLGQDSDGGSEEVVLTPAELIERLEQAWMNEKFAPELLESKPEIVECVMEQLEHMEENLRRAKREDLKVSIHQMEMERIRYVLSSYLRCRLMKIEKFFPHVLEKEKTRPEGEPSSLSPEELAFAREFMANTESYLKNVALKHMPPNLQKVDLFRAVPKPDLDSYVFLRVRERQENILVEPDTDEQRDYVIDLEKGSQHLIRYKTIAPLVASGAVQLI

SEQ ID NO: 47559 - protein, 223 aa, Homo sapiens; identical to SEQ ID NO: 47558

SEQ ID NO: 47560 - protein, 100 aa, Homo sapiens
MTEEVDFLGQDSDGGSEEVVLTPAELIERLEQAWMNEKFAPELLESKPEIVECVMEQLEHMEENLRRAKREDLKVSIHQMEMERIRYVLSSYLRCRLMKV

SEQ ID NO: 47561 - protein, 312 aa, Homo sapiens
MEGAAAREARGTETPRASAPPPAPSEPPAAPRARPRLVFRTQLAHGSPTGKIEGFTNVRELYAKIAEAFGIAPTEILFCTLNSHKVDMQKLLGGQIGLEDFIFAHVRGETKEVEVTKTEDALGLTITDNGAGYAFIKRIKEGSIINRIEAVCVGDSIEAINDHSIVGCRHYEVAKMLRELPKSQPFTLRLVQPKRAFDMIGQRSRSSKCPVEAKVTSGRETLRLRSGGAATVEEAPSEFEEEASRKVDDLLESYMGIRDPELASTMVETSKKTASAQEFARCLDSVLGEFAFPDEFVVEVWAAIGEAREACG

SEQ ID NO: 47562 - protein, 698 aa, Homo sapiens
MPSEGRCWETLKALRSSDKGRLCYYRDWLLRREDVLEECMSLPKLSSYSGWVVEHVLPHMQENQPLSETSPSSTSASALDQPSFVPKSPDASSAFSPASPATPNGTKGKDESQHTESMVLQSSRGIKVEGCVRMYELVHRMKGTEGLRLWQEEQERKVQALSEMASEQLKRFDEWKELKQHKEFQDLREVMEKSSREALGHQEKLKAEHRHRAKILNLKLREAEQQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRIEAITSSGQMGSFIRLKQFLEKCLQHKDIPVPKGFLTSSFWRS

SEQ ID NO: 47563 - protein, 659 aa, Homo sapiens
MPSEGRCWETLKALRSSDKGRLCYYRDWLLRREDVLEECMSLPKLSSYSGWVVEHVLPHMQENQPLSETSPSSTSASALDQPSFVPKSPDASSAFSPASPATPNGTKGKDESQHTESMVLQSSRGIKVEGCVRMYELVHRMKGTEGLRLWQEEQERKVQALSEMASEQLKRFDEWKELKQHKEFQDLREVMEKSSREALGHQEKLKAEHRHRAKILNLKLREAEQQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRYQAC

SEQ ID NO: 47564 - protein, 444 aa, Homo sapiens
MLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRIEAITSSGQMGSFIRLKQFLEKCLQHKDIPVPKGFLTSSFWRS

SEQ ID NO: 47565 - protein, 829 aa, Homo sapiens
MALTSINATPTQLSSSSNCLSDTNQNKQSSESAVSSTVNPVAIHKRSKVKTEPEGLRPASPLALTQGQVSGHGSCGCALPLSQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAPERTLPAGCPRPLGPRRGSDGPTYGHGHAGAAPAFPHEAPGGGARRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEASATWLSGT

SEQ ID NO: 47566 - protein, 1586 aa, Homo sapiens
METSASATASEKQEAKSGILEAAGFPDPGKKASPLVVAAAAAAAVAAQGVPQHLLPPFHAPLPIDMRHQEGRYHYEPHSVHGVHGPPALSGSPVISDISLIRLSPHPAGPGESPFNAPHPYVNPHMEHYLRSVHSSPTLSMISAARGLSPADVAQEHLKERGLFGLPAPGTTPSDYYHQMTLVAGHPAPYGDLLMQSGGAASAPHLHDYLNPVDVSRFSSPRVTPRLSRKRALSISPLSDASLDLQRMIRTSPNSLVAYINNSRSSSAASGSYGHLSAGALSPAFTFPHPINPVAYQQILSQQRGLGSAFGHTPPLIQPSPTFLAQQPMALTSINATPTQLSSSSNCLSDTNQNKQSSESAVSSTVNPVAIHKRSKVKTEPEGLRPASPLALTQGQVSGHGSCGCALPLSQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAPERTLPAGCPRPLGPRRGSDGPTYGHGHAGAAPAFPHEAPGGGARRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEVSSGTVDALASQVKPPPFPQGNLAVVQQKPAFGQYPGYSPQGLQASPGGLDSTQPHLQPRSGAPSQGIPRVNYMQQLRQPVAGSQCPGMTTTMSPHACYGQVHPQLSPSTISGALNQFPQSCSNMPAKPGHLGHPQQTEVAPDPTTMGNRHRELGVPDSALAGVPPPHPVQSYPQQSHHLAASMSQEGYHQVPSLLPARQPGFMEPQTGPMGVATAGFGLVQPRPPLEPSPTGRHRGVRAVQQQLAYARATGHAMAAMPSSQETAEAVPKGAMGNMGSVPPQPPPQDAGGAPDHSMLYYYGQIHMYEQDGGLENLGSCQVMRSQPPQPQACQDSIQPQPLPSPGVNQVSSTVDSQLLEAPQIDFDAIMDDGDHSSLFSGALSPSLLHSLSQNSSRLTTPRNSLTLPSIPAGISNMAVGDMSSMLTSLAEESKFLNMMT

SEQ ID NO: 47567 - protein, 82 aa, Homo sapiens
METSASATASEKQEAKSGILEAAGFPDPGKKASPLVVAAAAAAAVAAQGVPQHLLPPFHAPLPIDMRHQEGRYHYEPHSVHG

SEQ ID NO: 47568 - protein, 219 aa, Homo sapiens
METSASATASEKQEAKSGILEAAGFPDPGKKASPLVVAAAAAAAVAAQGVPQHLLPPFHAPLPIDMRHQEGRYHYEPHSVHGVHGVPFLQPAGDAPPEPQAGAVHLPTLRRQPGPAADDPHLTQLASGLHQQLPKQLGGQRFLRASVSGCPQPSLHLPPPHQPRGLPADSEPAEGSGVSLWTHTTPDPALTHLPGPAAHGPHLHQCHAHPAQQQQQLSE

SEQ ID NO: 47569 - protein, 1586 aa, Homo sapiens; identical to SEQ ID NO: 47566

SEQ ID NO: 47570 - protein, 1580 aa, Homo sapiens
MEAQSHSSTTTEKKKVENSIVKCSTRTDVSEKAVASSTTSNEDESPGQTYHRERRNAITMQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHRNPTAASESPFSPPHPYINPYMDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKCTFEGCTKAYSRLENLKTHLRSHTGEKPYVCEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGTQSNNTCSLGGPMTLLPGRSDLSGVDVTMLNMLNRRDSSASTISSAYLSSRRSSGISPCFSSRRSSEASQAEGRPQNVSVADSYDPISTDASRRSSEASQSDGLPSLLSLTPAQQYRLKAKYAAATGGPPPTPLPNMERMSLKTRLALLGDALEPGVALPPVHAPRRCSDGGAHGYGRRHLQPHDAPGHGVRRASDPVRTGSEGLALPRVPRFSSLSSCNPPAMATSAEKRSLVLQNYTRPEGGQSRNFHSSPCPPSITENVTLESLTMDADANLNDEDFLPDDVVQYLNSQNQAGYEQHFPSALPDDSKVPHGPGDFDAPGLPDSHAGQQFHALEQPCPEGSKTDLPIQWNEVSSGSADLSSSKLKCGPRPAVPQTRAFGFCNGMVVHPQNPLRSGPAGGYQTLGENSNPYGGPEHLMLHNSPGSGTSGNAFHEQPCKAPQYGNCLNRQPVAPGALDGACGAGIQASKLKSTPMQGSGGQLNFGLPVAPNESAGSMVNGMQNQDPVGQGYLAHQLLGDSMQHPGAGRPGQQMLGQISATSHINIYQGPESCLPGAHGMGSQPSSLAVVRGYQPCASFGGSRRQAMPRDSLALQSGQLSDTSQTCRVNGIKMEMKGQPHPLCSNLQNYSGQFYDQTVGFSQQDTKAGSFSISDASCLLQGTSAKNSELLSPGANQVTSTVDSLDSHDLEGVQIDFDAIIDDGDHSSLMSGALSPSIIQNLSHSSSRLTTPRASLPFPALSMSTTNMAIGDMSSLLTSLAEESKFLAVMQ

SEQ ID NO: 47571 - protein, 180 aa, Homo sapiens
MEAQSHSSTTTEKKKVENSIVKCSTRTDVSEKAVASSTTSNEDESPGQTYHRERRNAITMQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHR

SEQ ID NO: 47572 - protein, 376 aa, Homo sapiens
MAALGDIQESPSVPSPVSLSSPGTPGTQHHEPQLHLHGHQHGSPGSSPKVLSQPSDLDLQDVEEVEIGRDTFWPDSEPKPEQAPRSPGSQAPDEGAGGALRSLLRSLPRRARCSAGFGPESSAERPAGQPPGAVPCAQPRGAWRVTLVQQAAAGPEGAPERAAELGVNFGRSRQGSARGAKPHRCEACGKSFKYNSLLLKHQRIHTGEKPYACHECGKRFRGWSGFIQHHRIHTGEKPYECGQCGRAFSHSSHFTQHLRIHNGEKPYKCGECGQAFSQSSNLVRHQRLHTGEKPYACSQCGKAFIWSSVLIEHQRIHTGEKPYECSDCGKAFRGRSHFFRHLRTHTGEKPFACGACGKAFGQSSQLIQHQRVHYRE

SEQ ID NO: 47573 - protein, 376 aa, Homo sapiens; identical to SEQ ID NO: 47572

SEQ ID NO: 47574 - protein, 266 aa, Homo sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNRYTSLFLIVNSVILILSVIITILVQHKYPNLVLLD

SEQ ID NO: 47575 - protein, 142 aa, Homo sapiens
MSDSLVVCEVDPELTEKLRKFRFRKETDNAAIIMKVDKDRQMVVLEEEFQNISPEELKMELPERQPRFVVYSYKYVHDDGRVSYPLCFIFSSPVGCKPEQQMMYAGSKNRLVQTAELTKVFEIRTTDDLTEAWLQEKLSFFR

SEQ ID NO: 47576 - protein, 142 aa, Homo sapiens; identical to SEQ ID NO: 47575

SEQ ID NO: 47577 - protein, 432 aa, Homo sapiens
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRETSLDTKSVSEGHLKRNIVVKTVEMRDGEVIKESKQEHKDVM

SEQ ID NO: 47578 - protein, 179 aa, Homo sapiens
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKKQMKPPWPVWIWRGRLSRWRRRSGS

SEQ ID NO: 47579 - protein, 407 aa, Homo sapiens [sequence omitted]

SEQ ID NO: 47580 - protein, 431 aa, Homo sapiens
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRGGKSTKDGENHKVTRYLKSLTIRVIPIQAHQIVNGTPPARG

SEQ ID NO: 47581 - protein, 438 aa, Homo sapiens
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRGQYSRASWEGHWSPAPSSRACRLLQTGTEDQGKGIQLSLGAFVTLQRS

SEQ ID NO: 47582 - protein, 286 aa, Homo sapiens
MAARVLRARGAAWAGGLLQRAAPCSLLPRLRTWTSSSNRSREDSWLKSLFVRKVDPRKDAHSNLLAKKETSNLYKLQFHNVKPECLEAYNKICQEVLPKIHEDKHYPCTLVGTWNTWYGEQDQAVHLWRYEGGYPALTEVMNKLRENKEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 47583 - protein, 247 aa, Homo sapiens
MAARVLRARGAAWAGGLLQRAAPCSLLPRLRTWTSSSNRSREDSWLKSLFVRKVDPRKDAHSNLLAKKETSNLYKLQFKRCCQRFTKINTTLVLWWGLGTRGMASRTKLEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 47584 - protein, 1560 aa, Homo sapiens [sequence omitted]

SEQ ID NO: 47585 - protein, 478 aa, Homo sapiens
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKEQLWEKLAKQGELPREVRRAQARLLNPSATRAKPGPQDTVERPFYDLWASDNPLDRPLVGQDEFFLEQTKKKGVKRPARLHTKPSQAPAVEVAPAGASYNPSFEDHQTLLSAAHEVELQRQKEAEKLERQLALPATEQAATQESTFQELCEGLLEESDGEGEPGQGEGPEAGDAEVCPTPARLATTEKKTEQQRRREKAVHRLRVQQAALRAARLRHQELFRLRGIKAQVALRLAELARRQRRRQARREAEADKPRRLGRLKYQAPDIDVQLSSELTDSLRTLKPEGNILRDRFKSFQRRNMIEPRERAKFKRKYKVKLVEKRAFREIQL

SEQ ID NO: 47586 - protein, 472 aa, Homo sapiens
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKEQLWEKLAKQGELPREVRRAQARLLNPSATRAKPGPQDTVERPFYDLWASDNPLDRPLVGQDEFFLEQTKKKGVKRPARLHTKPSQAPAVEVAPAGASYNPSFEDHQTLLSAAHEVELQRQKEAEKLERQLALPATEQAATQESTFQELCEGLLEESDGEGEPGQGEGPEAGDAEVCPTPARHHREEDGAAAARRLCTGCGYSRPRCGPPGSGTRSCSGCAGSPGGPEAGGARRQRRRQARREAEADKPRRLGRLKYQAPDIDVQLSSELTDSLRTLKPEGNILRDRFKSFQRRNMIEPRERAKFKRKYKVKLVEKRAFREIQL

SEQ ID NO: 47587 - protein, 263 aa, Homo sapiens
MAAGGSGVGGKRSSKSDADSGFLGLRPTSVDPALRRRRRGPRNKKRGWRRLAQEPLGLEVDQFLEDVRLQERTSGGLLSEAPNEKLFFVDTGSKEKGLTKKRTKVQKKSLLLKKPLRVDLILENTSKVPAPKDVLAHQVPNAKKLRRKEQLWASDNPLDRPLVGQDEFFLEQTKKKGVKRREAEADKPRRLGRLKYQAPDIDVQLSSELTDSLRTLKPEGNILRDRFKSFQRRNMIEPRERAKFKRKYKVKLVEKRAFREIQL

SEQ ID NO: 47588 - protein, 551 aa, Homo sapiens
MARGAEGGRGDAGWGLRGALAAVALLSALNAAGTVFALCQWRGLSSALRALEAQRGREQREDSALRSFLAELSRAPRGASAPPQDPASSARNKRSHSGEPAPHIRAESHDMLMMMTYSMVPIRVMVDLCNSTKGICLTGPSGPPGPPGAGGLPGHNGLDGQPGPQGPKGEKGANGKRGKMGIPGAAGNPGERGEKGDHGELGLQGNEGPPGQKGEKGDKGDVSNDVLLAGAKGDQGPPGPPGPPGPPGPPGPPGSRRAKGPRQPSMFNGQCPGETCAIPNDDTLVGKADEKASEHHSPQAESMITSIGNPVQVLKVTETFGTWIRESANKSDDRIWVTEHFSGIMVKEFKDQPSLLNGSYTFIHLPYYFHGCGHVVYNNSLYYHKGGSNTLVRFEFGQETSQTLKLENALYFDRKYLFANSKTYFNLAVDEKGLWIIYASSVDGSSILVAQLDERTFSVVQHVNTTYPKSKAGNAFIARGILYVTDTKDMRVTFAFDLLGGKQINANFDLRTSQSVLAMLAYNMRDQHLYSWEDGHLMLYPVQFLSTTLNQ

SEQ ID NO: 47589 - protein, 427 aa, Homo sapiens
MVDLCNSTKGICLTGPSGPPGPPGAGGLPGHNGLDGQPGPQGPKGEKGANGKRGKMGIPGAAGNPGERGEKGDHGELGLQGNEGPPGQKGEKGDKGDVSNDVLLAGAKGDQGPPGPPGPPGPPGPPGPPGSRRAKGPRQPSMFNGQCPGETCAIPNDDTLVGKADEKASEHHSPQAESMITSIGNPVQVLKVTETFGTWIRESANKSDDRIWVTEHFSGIMVKEFKDQPSLLNGSYTFIHLPYYFHGCGHVVYNNSLYYHKGGSNTLVRFEFGQETSQTLKLENALYFDRKYLFANSKTYFNLAVDEKGLWIIYASSVDGSSILVAQLDERTFSVVQHVNTTYPKSKAGNAFIARGILYVTDTKDMRVTFAFDLLGGKQINANFDLRTSQSVLAMLAYNMRDQHLYSWEDGHLMLYPVQFLSTTLNQ

SEQ ID NO: 47590 - protein, 427 aa, Homo sapiens; identical to SEQ ID NO: 47589

SEQ ID NO: 47591 - protein, 524 aa, Homo sapiens
MHSLDEPLDLKLSITKLRAAREKRERTLGVVRPRALHRELGLVDDSPTPGSPGSPPSGFLLNSKFPEKVEGRFSAAPLVDLSLSPPSGLDSPNGSSSLSPERQGNGDLPPVPSASDFQPLRYLDGVPSSFQFFLPLGSGGALHLPASSFLTPPKDKCLSPDLPLPKQLVCRWAKCNQLFELLQDLVDHVNDYHVKPEKDAGYCCHWEGCARHGRGFNARYKMLIHIRTHTNEKPHRCPTCSKSFSRLENLKIHNRSHTGEKPYVCPYEGCNKRYSNSSDRFKHTRTHYVDKPYYCKMPGCHKRYTDPSSLRKHIKAHGHFVSHEQQELLQLRPPPKPPLPAPDGGPYVSGAQIIIPNPAALFGGPGLPGLPLPLAPGPLDLSALACGNGGGSGGGGGMGPGLPGPVLPLNLAKNPLLPSPFGAGGLGLPVVSLLAGAAGGKAEGEKGRGSVPTRALGMEGHKTPLERTESSCSRPSPDGLPLLPGTVLDLSTGVNSAASSPEALAPGWVVIPPGSVLLKPAVVN

SEQ ID NO: 47592 - protein, 524 aa, Homo sapiens; identical to SEQ ID NO: 47591

SEQ ID NO: 47593 - protein, 775 aa, Homo sapiens
MMVQRLGLISPPASQVSTACNQISPSLQRAMNAANLNIPPSDTRSLISRESLASTTLSLTESQSASSMKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVAYINGSRASPANLSPQPEVYGHFLGVRGSCIPQPRPVPGSQKGVLVAPGGLALPAYGEDGALEHERMQQLEHGGLQPGLVNHMVVQHGLPGPDSQSAGLFKTERLEEFPGSTVDLPPAPPLPPLPPPPGPPPPYHAHAHLHHPELGPHAQQLALPQATLDDDGEMDGIGGKHCCRWIDCSALYDQQEELVRHIEKVHIDQRKGEDFTCFWAGCPRRYKPFNARYKLLIHMRVHSGEKPNKCTFEGCEKAFSRLENLKIHLRSHTGEKPYLCQHPGCQKAFSNSSDRAKHQRTHLDTKPYACQIPGCTKRYTDPSSLRKHVKAHSSKEQQARKKLRSSTELHPDLLTDCLTVQSLQPATSPRDAAAEGTVGRSPGPGPDLYSAPIFSSNYSSRSGTAAGAVPPPHPVSHPSPGHNVQGSPHNPSSQLPPLTAVDAGAERFAPSAPSPHHISPRRVPAPSSILQRTQPPYTQQPSGSHLKSYQPETNSSFQPNGIHVHGFYGQLQKFCPPHYPDSQRIVPPVSSCSVVPSFEDCLVPTSMGQASFDVFHRAFSTHSGITVYDLPSSSSSLFGESLRSGAEDATFLQISTVDRCPSQLSSVYTEG

SEQ ID NO: 47594 - protein, 930 aa, Homo sapiens
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGALGFGPQCKSIGKGSCNNLVVTSSPMMVQRLGLISPPASQVSTACNQISPSLQRAMNAANLNIPPSDTRSLISRESLASTTLSLTESQSASSMKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVAYINGSRASPANLSPQPEVYGHFLGVRGSCIPQPRPVPGSQKGVLVAPGGLALPAYGEDGALEHERMQQLEHGGLQPGLVNHMVVQHGLPGPDSQSAGLFKTERLEEFPGSTVDLPPAPPLPPLPPPPGPPPPYHAHAHLHHPELGPHAQQLALPQATLDDDGEMDGIGGKHCCRWIDCSALYDQQEELVRHIEKVHIDQRKGEDFTCFWAGCPRRYKPFNARYKLLIHMRVHSGEKPNKCTFEGCEKAFSRLENLKIHLRSHTGEKPYLCQHPGCQKAFSNSSDRAKHQRTHLDTKPYACQIPGCTKRYTDPSSLRKHVKAHSSKEQQARKKLRSSTELHPDLLTDCLTVQSLQPATSPRDAAAEGTVGRSPGPGPDLYSAPIFSSNYSSRSGTAAGAVPPPHPVSHPSPGHNVQGSPHNPSSQLPPLTAVDAGAERFAPSAPSPHHISPRRVPAPSSILQRTQPPYTQQPSGSHLKSYQPETNSSFQPNGIHVHGFYGQLQKFCPPHYPDSQRIVPPVSSCSVVPSFEDCLVPTSMGQASFDVFHRAFSTHSGITVYDLPSSSSSLFGESLRSGAEDATFLQISTVDRCPSQLSSVYTEG

SEQ ID NO: 47595 - protein, 89 aa, Homo sapiens
MMVQRLGLISPPASQVSTACNQISPSLQRAMNAANLNIPPSDTRSLISRESLASTTLSLTESQSASSMKQEWSQGYRALPSLSNHGSQN

SEQ ID NO: 47596 - protein, 244 aa, Homo sapiens
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGALGFGPQCKSIGKGSCNNLVVTSSPMMVQRLGLISPPASQVSTACNQISPSLQRAMNAANLNIPPSDTRSLISRESLASTTLSLTESQSASSMKQEWSQGYRALPSLSNHGSQN

SEQ ID NO: 47597 - protein, 89 aa, Homo sapiens; identical to SEQ ID NO: 47595

SEQ ID NO: 47598 - protein, 89 aa, Homo sapiens; identical to SEQ ID NO: 47595

SEQ ID NO: 47599 - protein, 244 aa, Homo sapiens; identical to SEQ ID NO: 47596

SEQ ID NO: 47600 - protein, 72 aa, Homo sapiens
MHRRRLALGLGFCLLAGTSLSVLWVYLENWLPVSYVPYYLPCPEILLEYRGVISAHCNLHLPGSSNCHASAT

SEQ ID NO: 47601 - protein, 160 aa, Homo sapiens
MHRRRLALGLGFCLLAGTSLSVLWVYLENWLPVSYVPYYLPCPEILPMMMALSCLCHQQHEAALQEGEATPARGMVTVPSAQAAGAQAHTAADTHTLVGAHRLRGNLQPRASAAHLPATEPDHWGHGVCRGEVHSFHPVLPGVSRGVLHAWVPGALLHLH

SEQ ID NO: 47602 - protein, 347 aa, Homo sapiens
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGKYTHFIQSFLESAEEFFMRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 47603 - protein, 294 aa, Homo sapiens
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGNPSWSQPRSSSCVGTGCTTTSSLTTLQPFPGSRWVPTGFSAPSPSRVTPTGRRHPCAGWRPSASTLLRGLTGRWTTSSALMWTWCFGTRGALRPWETWWLPFTQATTPFPASSSPMSAGVFPLPLWQTAKGTSIMVGQSSGGRWPGYMSLLGAATWPSWRTRPMASWLPGGRKAT

SEQ ID NO: 47604 - protein, 330 aa, Homo sapiens
MHRRRLALGLGFCLLAGTSLSVLWVYLENWLPVSYVPYYLPCPEILSQYPQPKLLEHRPTQLLTLTPWLAPIVSEGTFNPELLQHIYQPLNLTIGVTVFAVGKYTHFIQSFLESAEEFFMRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 47605 - protein, 477 aa, Homo sapiens
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 47606 - protein, 463 aa, Homo sapiens
MAGAPGPLRLALLLLGMVGRAGPRPQGATVSLWETVQKWREYRRQCQRSLTEDPPPATDLFCNRTFDEYACWPDGEPGSFVNVSCPWYLPWASSVPQGHVYRFCTAEGLWLQKDNSSLPWRDLSECEESKRGERSSPEEQLLFLYIIYTVGYALSFSALVIASAILLGFRHLHCTRNYIHLNLFASFILRALSVFIKDAALKWMYSTAAQQHQWDGLLSYQDSLSCRLVFLLMQYCVAANYYWLLVEGVYLYTLLAFSVLSEQWIFRLYVSIGWGVPLLFVVPWGIVKYLYEDEGCWTRNSNMNYWLIIRLPILFAIGVNFLIFVRVICIVVSKLKANLMCKTDIKCRLAKSTLTLIPLLGTHEVIFAFVMDEHARGTLRFIKLFTELSFTSFQGLMVAILYCFVNNEVQLEFRKSWERWRLEHLHIQRDSSMKPLKCPTSSLSSGATAGSSMYTATCQASCS

SEQ ID NO: 47607 - protein, 553 aa, Homo sapiens
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 47608 - protein, 350 aa, Homo sapiens
MGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTALGLEETGLKRNGSIPFGHKEDI

SEQ ID NO: 47609 - protein, 554 aa, Homo sapiens
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEEKRSQ

SEQ ID NO: 47610 - protein, 228 aa, Homo sapiens
  MOD_RES (1)..(1): Any amino acid
XATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTALGLEETGLKRNGSIPFGHKEDI

SEQ ID NO: 47611 - protein, 547 aa, Homo sapiens
MSTASSSSSSSSSQTPHPPSQRMRRSAAGSPPAVAAAGSGNGAGGGGGVGCAPAAGAGRLLQPIRATVPYQLLRGSQHSPTRPPVAAAAASLGSLPGPGAARGPSPSSPTPPAAAAPAEQAPRAKGRPRRSPESHRRSSSPERRSPGSPVCRADKAKSQQVRTSSTIRRTSSLDTITGPYLTGQWPRDPHVHYPSCMKDKATQTPSCWAEEGAEKRSHQRSASWGSADQLKEQIAKLRQQLQRSKQSSRHSKEKDRQSPLHGNHITISHTQATGSRSVPMPLSNISVPKSSVSRVPCNVEGISPELEKVFIKENNGKEEVSKPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMASRQPISAPLFSCPDKNKVNFIPTGSAFCPVKLLGPLLPASDLMLKNSPNSGQSSALATLTVEQLSSRVSFTSLSDDTSTAGSMEASVQQPSQQQQLLQELQGEDHISAQNYVII

SEQ ID NO: 47612 - protein, 573 aa, Homo sapiens
MANAEVSVPVGDVVVVPTEGNEGENPEDTKTQVILQLQPVQQGLFIDGHFYNRIYEAGSENNTAVVAVETHTIHKIEEGIDTGTIEANEDMEIAYPITCGESKAILLWKKFVCPGINVKCVKFNDQLISPKHFVHLAGKSTLKDWKRAIRLGGIMLRKMMDSGQIDFYQHDKVCSNTCRSTKFDLLISSARAPVPGQQTSVVQTPTSADGSITQIAISEESMEEAGLEWNSALTAAVTMATEEGVKKDSEEISEDTLMFWKGIADVGLMEEVVCNIQKEIEELLRGVQQRLIQAPFQVTDAAVLNNVAHTFGLMDTVKKVLDNRRNQVEQGEEQFLYTLTDLERQLEEQKKQGQDHRLKSQTVQNVVLMPVSTPKPPKRPRLQRPASTTVLSPSPPVQQPQFTVISPITITPVGQSFSMGNIPVATLSQGSSPVTVHTLPSGPQLFRYATVVSSAKSSSPDTVTIHPSSSLALLSSTAMQDGSTLGNMTTMVSPVELVAMESGLTSAIQAVESTSEDGQTIIEIDPAPDPEAEDTEGKAVILETELRTEEKVVAEMEEHQHQVHNVEIVVLED

SEQ ID NO: 47613 - protein, 563 aa, Homo sapiens
MANAEVSVPVGDVVVVPTEGNEGENPEDTKTQVILQLQPVQQGIYEAGSENNTAVVAVETHTIHKIEEGIDTGTIEANEDMEIAYPITCGESKAILLWKKFVCPGINVKCVKFNDQLISPKHFVHLAGKSTLKDWKRAIRLGGIMLRKMMDSGQIDFYQHDKVCSNTCRSTKFDLLISSARAPVPGQQTSVVQTPTSADGSITQIAISEESMEEAGLEWNSALTAAVTMATEEGVKKDSEEISEDTLMFWKGIADVGLMEEVVCNIQKEIEELLRGVQQRLIQAPFQVTDAAVLNNVAHTFGLMDTVKKVLDNRRNQVEQGEEQFLYTLTDLERQLEEQKKQGQDHRLKSQTVQNVVLMPVSTPKPPKRPRLQRPASTTVLSPSPPVQQPQFTVISPITITPVGQSFSMGNIPVATLSQGSSPVTVHTLPSGPQLFRYATVVSSAKSSSPDTVTIHPSSSLALLSSTAMQDGSTLGNMTTMVSPVELVAMESGLTSAIQAVESTSEDGQTIIEIDPAPDPEAEDTEGKAVILETELRTEEKVVAEMEEHQHQVHNVEIVVLED

SEQ ID NO: 47614 - protein, 563 aa, Homo sapiens; identical to SEQ ID NO: 47613

SEQ ID NO: 47615 - protein, 360 aa, Homo sapiens
MLRRLPALAARRPPARRRRIYEAGSENNTAVVAVETHTIHKIEEGIDTGTIEANEDMEIAYPITCGESKAILLWKKFVCPGINVKCVKFNDQLISPKHFVHLAGKSTLKDWKRAIRLGGIMLRKMMDSGQIDFYQHDKVCSNTCRSTKFDLLISSARAPVPGQQTSVVQTPTSADGSITQIAISEESMEEAGLEWNSALTAAVTMATEEGVKKDSEEISEDTLMFWKGIADVGLMEEVVCNIQKEIEELLRGVQQRLIQAPFQVTDAAVLNNVAHTFGLMDTVKKVLDNRRNQVEQGEEQFLYTLTDLERQLEEQKKQGQDHRLKSQTVQNVVLMPVSTPKPPKRPRLQRPASTTVLSPS

SEQ ID NO: 47616 - protein, 530 aa, Homo sapiens
MATPDVSVHMEEVVVVTTPDTAVDGSGVEGVKTVLVTTNLAPHGGDLTEDNMETENAAAAAAAAFTASSQLKEAVLVKMAEEGENLEAEIVYPITCGDSRANLIWRKFVCPGINVKCVQYDEHVISPKEFVHLAGKSTLKDWKRAIRMNGIMLRKIMDSGELDFYQHDKVCSNTCRSTKIDLSGARVSLSSPTSAEYIPLTPAAADVNGSPATITIETCEDPGDWTAAIGDDTFTFWRGLKDAGLLDEVIQEFHQELVETMRGLQQRVQDPPLQLRDAVLLNNIVQNFGMLDLVKKVLASHKCQMDRSREQYARDLAALEQQCDEHRRRAKELKHKSQHLSNVLMTLTPVSLPPPVKRPRLARATSGPAAMASQVLTQSAQLALGPGVPVPQLTSVPLGKVVSTLPSTVLGKGSLQAPPASSPASPLLGGYTVLASSGSTYPSTVEIHPDASSLTVLSTAAVQDGSTVFKVVSPLQLLTLPGLGPTLQNVAQASPGSSTIVTVPAGAAPGPEEHTATIEVAAMAEDHERK

SEQ ID NO: 47617 - protein, 479 aa, Homo sapiens
METENAAAAAAAAFTASSQLKEAVLVKMAEEGENLEAEIVYPITCGDSRANLIWRKFVCPGINVKCVQYDEHVISPKEFVHLAGKSTLKDWKRAIRMNGIMLRKIMDSGELDFYQHDKVCSNTCRSTKIDLSGARVSLSSPTSAEYIPLTPAAADVNGSPATITIETCEDPGDWTAAIGDDTFTFWRGLKDAGLLDEVIQEFHQELVETMRGLQQRVQDPPLQLRDAVLLNNIVQNFGMLDLVKKVLASHKCQMDRSREQYARDLAALEQQCDEHRRRAKELKHKSQHLSNVLMTLTPVSLPPPVKRPRLARATSGPAAMASQVLTQSAQLALGPGVPVPQLTSVPLGKVVSTLPSTVLGKGSLQAPPASSPASPLLGGYTVLASSGSTYPSTVEIHPDASSLTVLSTAAVQDGSTVFKVVSPLQLLTLPGLGPTLQNVAQASPGSSTIVTVPAGAAPGPEEHTATIEVAAMAEDHERK

SEQ ID NO: 47618 - protein, 530 aa, Homo sapiens; identical to SEQ ID NO: 47616

SEQ ID NO: 47619 - protein, 466 aa, Homo sapiens
MAMDVTRSQAQTALTLVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMLFDYISECISDFLDKHQMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 47620 - protein, 464 aa, Homo sapiens
MPRPRSQLPQPNSQVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMLFDYISECISDFLDKHQMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 47621 - protein, 465 aa, Homo sapiens [sequence omitted]

SEQ ID NO: 47622 - protein, 625 aa, Homo sapiens
MPGTKRFQHVIETPEPGKWELSGYEAAVPITEKSNPLTQDLDKADAENIVRLLGQCDAEIFQEEGQALSTYQRLYSESILTTMVQVAGKVQEVLKEPDGGLVVLSGGGTSGRMAFLMSVSFNQLMKGLGQKPLYTYLIAGGDRSVVASREGTEDSALHGIEELKKVAAGKKRVIVIGISVGLSAPFVAGQMDCCMNNTAVFLPVLVGFNPVSMARNDPIEDWSSTFRQVAERMQKMQEKQKAFVLNPAIGPEGLSGSSRMKGGSATKILLETLLLAAHKTVDQGIAASQRCLLEILRTFERAHQVTYSQSPKIATLMKSVSTSLEKKGHVYLVGWQTLGIIAIMDGVECIHTFGADFRDVRGFLIGDHSDMFNQKAELTNQGPQFTFSQEDFLTSILPSLTEIDTVVFIFTLDDNLTEVQTIVEQVKEKTNHIQALAHSTVGQTLLIPLKKLFPSIISITWPLLFFEYEGNFIQKFQRELSTKWVLNTVSTGAHVLLGKILQNHMLDLRISNSKLFWRALAMLQRFSGQSKARCIESLLRAIHFPQPLSDDIRAAPISCHVQVAHEKEQVIPIALLSLLFRCSITEAQAHLAAAPSVCEAVRSALAGPGQKRTADPLEILEPDVQ

SEQ ID NO: 47623 - protein, 435 aa, Homo sapiens
MDCCMNNTAVFLPVLVGFNPVSMARNDPIEDWSSTFRQVAERMQKMQEKQKAFVLNPAIGPEGLSGSSRMKGGSATKILLETLLLAAHKTVDQGIAASQRCLLEILRTFERAHQVTYSQSPKIATLMKSVSTSLEKKGHVYLVGWQTLGIIAIMDGVECIHTFGADFRDVRGFLIGDHSDMFNQKAELTNQGPQFTFSQEDFLTSILPSLTEIDTVVFIFTLDDNLTEVQTIVEQVKEKTNHIQALAHSTVGQTLLIPLKKLFPSIISITWPLLFFEYEGNFIQKFQRELSTKWVLNTVSTGAHVLLGKILQNHMLDLRISNSKLFWRALAMLQRFSGQSKARCIESLLRAIHFPQPLSDDIRAAPISCHVQVAHEKEQVIPIALLSLLFRCSITEAQAHLAAAPSVCEAVRSALAGPGQKRTADPLEILEPDVQ

SEQ ID NO: 47624 - protein, 552 aa, Homo sapiens
MRLLPLAPGRLRRGSPRHLPSCSPALLLLVLGGCLGVFGVAAGTRRPNVVLLLTDDQDEVLGGMTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 47625 - protein, 469 aa, Homo sapiens
MYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 47626 - protein, 532 aa, Homo sapiens
MRLLPLAPGRLRRGSPRHLPSCSPALLLLVLGGCLGVFGVAAGTRRPNVVLLLTDDQDEVLGGMYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 47627 - protein, 717 aa, Homo sapiens
MPIGDCSVAAKPRKQLLCSLFQTTLGYRARASGWKPMVICRGSHAFKDLINTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 47628 - protein, 722 aa, Homo sapiens
MEKNGNNRKLRVCVATCNRADYSKLAPIMFGIKTEPEFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 47629 - protein, 753 aa, Homo sapiens
METYGYLQRESCFQGPHELYFKNLSKRNKQIMEKNGNNRKLRVCVATCNRADYSKLAPIMFGIKTEPEFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 47630 - protein, 132 aa, Homo sapiens
MFELTLDALISFNKRTLVLFPNIDAGSKEMVRVMRKKGIEHHPNFRAVKHVPFDQFIQLVAHAGCMIGNSSCGVREVGALTRLYTYVSCYKHTHTHTHTHPSSSNPKLRSQKVIQSENRGKSYQEGLKYTFF

SEQ ID NO: 47631 - protein, 722 aa, Homo sapiens; identical to SEQ ID NO: 47628

SEQ ID NO: 47632 - protein, 648 aa, Homo sapiens
MEKNGNNRKLRVCVATCNRADYSKLAPIMFGIKTEPEFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 47633 - protein, 612 aa, Homo sapiens
MIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 47634 - protein, 289 aa, Homo sapiens
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKGLMLVHNKLVDPLYSIKEKETEKSQSSKKPYSD

SEQ ID NO: 47635 - protein, 255 aa, Homo sapiens
MKLIILEHYSQASEWAAKYIRNRIIQFNPGPEKYFTLGLPTGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKGLMLVHNKLVDPLYSIKEKETEKSQSSKKPYSD

SEQ ID NO: 47636 - protein, 289 aa, Homo sapiens; identical to SEQ ID NO: 47634

SEQ ID NO: 47637 - protein, 138 aa, Homo sapiens
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGI

SEQ ID NO: 47638 - protein, 289 aa, Homo sapiens; identical to SEQ ID NO: 47634

SEQ ID NO: 47639 - protein, 29 aa, Homo sapiens
MKLIILEHYSQASEWAAKYIRNRIIQFNP

SEQ ID NO: 47640 - protein, 289 aa, Homo sapiens; identical to SEQ ID NO: 47634

SEQ ID NO: 47641 - protein, 161 aa, Homo sapiens
MKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKT

SEQ ID NO: 47642 - protein, 212 aa, Homo sapiens
MKLIILEHYSQASEWAAKYIRNRIIQFNPGPEKYFTLGLPTGSTPLGCYKKLIEYYKNGDLSFKYVKTFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKGLMLVHNKLVDPLYSIKEKETEKSQSSKKPYSD

SEQ ID NO: 47643 - protein, 276 aa, Homo sapiens
MRLVILDNYDLASEWAAKYICNRIIQFKPGQDRYFTLGLPTGSTPLGCYKKLIEYHKNGHLSFKYVKTFNMDEYVGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKGLMHVHNKLVDPLFSMKDGN

SEQ ID NO: 47644 - protein, 259 aa, Homo sapiens
MRLVILDNYDLASEWAAKYICNRIIQFKPGQDRYFTLGLPTGSTPLGCYKKLIEYHKNGHLSFKYVKTFNMDEYVGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKGEH

SEQ ID NO: 47645 - protein, 242 aa, Homo sapiens
MRLVILDNYDLASEWAAKYICNRIIQFKPGQDRYFTLGLPTGLPRNHPESYHSYMWNNFFKHIDIDPNNAHILDGNAADLQAECDAFENKIKEAGGIDLFVGGIGPDGHIAFNEPGSSLVSRTRLKTLAMDTILANAKYFDGDLSKVPTMALTVGVGTVMDAREVMILITGAHKAFALYKAIEEGVNHMWTVSAFQQHPRTIFVCDEDATLELRVKTVKYFKGLMHVHNKLVDPLFSMKDGN

SEQ ID NO: 47646 - protein, 428 aa, Homo sapiens
MLRTLLRRRLFSYPTKYYFMVLVLSLITFSVLRIHQKPEFVSVRHLELAGENPSSDINCTKVLQGDVNEIQKVKLEILTVKFKKRPRWTPDDYINMTSDCSSFIKRRKYIVEPLSKEEAEFPIAYSIVVHHKIEMLDRLLRAIYMPQNFYCIHVDTKSEDSYLAAVMGIASCFSNVFVASRLESVVYASWSRVQADLNCMKDLYAMSANWKYLINLCGMDFPIKTNLEIVRKLKLLMGENNLETERMPSHKEERWKKRYEVVNGKLTNTGTVKMLPPLETPLFSGSAYFVVSREYVGYVLQNEKIQKLMEWAQDTYSPDEYLWATIQRIPEVPGSLPASHKYDLSDMQAVARFVKWQYFEGDVSKGAPYPPCDGVHVRSVCIFGAGDLNWMLRKHHLFANKFDVDVDLFAIQCLDEHLRHKALETLKH

SEQ ID NO: 47647 - protein, 428 aa, Homo sapiens; identical to SEQ ID NO: 47646

SEQ ID NO: 47648 - protein, 428 aa, Homo sapiens; identical to SEQ ID NO: 47646

SEQ ID NO: 47649 - protein, 428 aa, Homo sapiens; identical to SEQ ID NO: 47646

SEQ ID NO: 47650 - protein, 402 aa, Homo sapiens
MNFWRYCFFAFTLLSVVIFVRFYSSQLSPPKSYEKLNSSSERYFRKTACNHALEKMPVFLWENILPSPLRSVPCKDYLTQNHYITSPLSEEEAAFPLAYVMVIHKDFDTFERLFRAIYMPQNVYCVHVDEKAPAEYKESVRQLLSCFQNAFIASKTESVVYAGISRLQADLNCLKDLVASEVPWKYVINTCGQDFPLKTNREIVQHLKGFKGKNITPGVLPPDHAIKRTKYVHQEHTDKGGFFVKNTNILKTSPPHQLTIYFGTAYVALTRDFVDFVLRDQRAIDLLQWSKDTYSPDEHFWVTLNRVSGVPGSMPNASWTGNLRAIKWSDMEDRHGGCHGHYVHGICIYGNGDLKWLVNSPSLFANKFELNTYPLTVECLELRHRERTLNQSETAIQPSWYF

SEQ ID NO: 47651 - protein, 400 aa, Homo sapiens
MPLSMRYLFIISVSSVIIFIVFSVFNFGGDPSFQRLNISDPLRLTQVCTSFINGKTRFLWKNKLMIHEKSSCKEYLTQSHYITAPLSKEEADFPLAYIMVIHHHFDTFARLFRAIYMPQNIYCVHVDEKATTEFKDAVEQLLSCFPNAFLASKMEPVVYGGISRLQADLNCIRDLSAFEVSWKYVINTCGQDFPLKTNKEIVQYLKGFKGKNITPGVLPPAHAIGRTKYVHQEHLGKELSYVIRTTALKPPPPHNLTIYFGSAYVALSREFANFVLHDPRAVDLLQWSKDTFSPDEHFWVTLNRIPGVPGSMPNASWTGNLRAIKWSDMEDRHGGCHGHYVHGICIYGNGDLKWLVNSPSLFANKFELNTYPLTVECLELRHRERTLNQSETAIQPSWYF

SEQ ID NO: 47652 - protein, 402 aa, Homo sapiens
MMGSWKHCLFSASLISALIFVFVYNTELWENKRFLRAALSNASLLAEACHQIFEGKVFYPTENALKTTLDEATCYEYMVRSHYVTETLSEEEAGFPLAYTVTIHKDFGTFERLFRAIYMPQNVYCVHLDQKATDAFKGAVKQLLSCFPNAFLASKKESVVYGGISRLQADLNCLEDLVASEVPWKYVINTCGQDFPLKTNREIVQYLKGFKGKNITPGVLPPDHAVGRTKYVHQELLNHKNSYVIKTTKLKTPPPHDMVIYFGTAYVALTRDFANFVLQDQLALDLLSWSKDTYSPDEHFWVTLNRIPGVPGSMPNASWTGNLRAIKWSDMEDRHGGCHGHYVHGICIYGNGDLKWLVNSPSLFANKFELNTYPLTVECLELRHRERTLNQSETAIQPSWYF

SEQ ID NO: 47653 - protein, 402 aa, Homo sapiens; identical to SEQ ID NO: 47652

SEQ ID NO: 47654 - protein, 438 aa, Homo sapiens
MVQWKRLCQLHYLWALGCYMLLATVALKLSFRLKCDSDHLGLESRESQSQYCRNILYNFLKLPAKRSINCSGVTRGDQEAVLQAILNNLEVKKKREPFTDTHYLSLTRDCEHFKAERKFIQFPLSKEEVEFPIAYSMVIHEKIENFERLLRAVYAPQNIYCVHVDEKSPETFKEAVKAIISCFPNVFIASKLVRVVYASWSRVQADLNCMEDLLQSSVPWKYFLNTCGTDFPIKSNAEMVQALKMLNGRNSMESEVPPKHKETRWKYHFEVVRDTLHLTNKKKDPPPYNLTMFTGNAYIVASRDFVQHVLKNPKSQQLIEWVKDTYSPDEHLWATLQRARWMPGSVPNHPKYDISDMTSIARLVKWQGHEGDIDKGAPYAPCSGIHQRAICVYGAGDLNWMLQNHHLLANKFDPKVDDNALQCLEEYLRYKAIYGTEL

SEQ ID NO: 47655 - protein, 87 aa, Homo sapiens
MVQWKRLCQLHYLWALGCYMLLATVALKLSFRLKCDSDHLGLESRESQSQYCRNILYNFLKLPAKRSINCSGVTRGDQEAVLQAILN

SEQ ID NO: 47656 - protein, 153 aa, Homo sapiens
MVQWKRLCQLHYLWALGCYMLLATVALKLSFRLKCDSDHLGLESRESQSQYCRNILYNFLKLPAKRSINCSGVTRGDQEAVLQAILNNLEVKKKREPFTDTHYLSLTRDCEHFKAERKFIQFPLSKEEVEFPIAYSMVIHEKIENFERLLRAV

SEQ ID NO: 47657 - protein, 53 aa, Homo sapiens
MVQWKRLCQLHYLWALGCYMLLATVALKLSFRLKCDSDHLGLESRESQSQYCR

SEQ ID NO: 47658 - protein, 438 aa, Homo sapiens; identical to SEQ ID NO: 47654

SEQ ID NO: 47659 - protein, 346 aa, Homo sapiens
MESTLGAGIVIAEALQNQLAWLENVWLWITFLGDPKILFLFYFPAAYYASRRVGIAVLWISLITEWLNLIFKWFLFGDRPFWWVHESGYYSQAPAQVHQFPSSCETGPGSPSGHCMITGAALWPIMTALSSQVATRARSRWVRVMPSLAYCTFLLAVGLSRIFILAHFPHQVLAGLITGAVLGWLMTPRVPMERELSFYGLTALALMLGTSLIYWTLFTLGLDLSWSISLAFKWCERPEWIHVDSRPFASLSRDSGAALGLGIALHSPCYAQVRRAQLGNGQKIACLVLAMGLLGPLDWLGHPPQISLFYIFNFLKYTLWPCLVLALVPWAVHMFSAQEAPPIHSS

SEQ ID NO: 47660 - protein, 154 aa, Homo sapiens
MDFLHRNGVLIIQHLQKDYRAYYTFLNFMSNVGDPRNIFFIYFPLCFQFNQTVGTKMIWVAVIGDWLNLIFKWILFGHRPYWWVQETQIYPNHSSPCLEQFPTTCETGPGSPSGHAMGASCVWYVMVTAALSHTVCGMDKFSITLHRHAGGRGL

SEQ ID NO: 47661 - protein, 355 aa, Homo sapiens
MDFLHRNGVLIIQHLQKDYRAYYTFLNFMSNVGDPRNIFFIYFPLCFQFNQTVGTKMIWVAVIGDWLNLIFKWILFGHRPYWWVQETQIYPNHSSPCLEQFPTTCETGPGSPSGHAMGASCVWYVMVTAALSHTVCGMDKFSITLHRLTWSFLWSVFWLIQISVCISRVFIATHFPHQVILGVIGGMLVAEAFEHTPGIQTASLGTYLKTNLFLFLFAVGFYLLLRVLNIDLLWSVPIAKKWCANPDWIHIDTTPFAGLVRNLGVLFGLGFAINSEMFLLSCRGGNNYTLSFRLLCALTSLTILQLYHFLQIPTHEEHLFYVLSFCKSASIPLTVVAFIPYSVHMLMKQSGKKSQ

SEQ ID NO: 47662 - protein, 558 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 47663 - protein, 520 aa, Homo sapiens
SRHGRSHPGPPVPEAAAMVPRAPLRAEPAPPLRCQQGPLQPLQVRAGRRRGLPRAAPGTGHAGLGSGGGGSGARGPQSPTSRPRTGAQAESALRPWSLLGVRSWGLAASPGVSAPGLLRYEEKRAPPWGHFPSSSPCSSGHLSRGSFRSCEERPWLTQQAGKGCPFPSAPGHMSLGASAGRAARAGVFEGAGWKDGDVGRDSCRRHLCTTGKWEGVFEQIMGGSAAKGALITDTGGGGGGERLWLRARRPDGHPCHLDGCLSNLRQKVEALGRGGPPLQSGLLIQGLPASTVCEDGFFLWAAVADHPGGPAGDRHHHCAGWPRPLWGVGQGGCFFWEQLLLRAWLPARETRVWSAASPSFCSLTLNTNHGHILVDYSKNLVTEDVMRMLVDLAKSRGVEAARERMFNGEKINYTEVSRPHIPSGASFLPFGVYLTVSRITLCLHPFSWAMLLLNEGPEGLFPPACSRALGCAFHKIGLVSSLEWFPVSAWEEHISYPQGEFLKADIFLEKLTLIYPQCKF

SEQ ID NO: 47664 - protein, 569 aa, Homo sapiens
MVALCSLQHLGSSDPRALPTLPTATSGQRPAKRRRKSPAMAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 47665 - protein, 966 aa, Homo sapiens
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSFSDKVNLTLGSIWDKIKNLFSRQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 47666 - protein, 944 aa, Homo sapiens
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 47667 - protein, 847 aa, Homo sapiens
MTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 47668 - protein, 914 aa, Homo sapiens
MEAAVKEEISLEDEAVDKNIFRDCNKIAFYRRQKQWLSKKSTYQALLDSVTTDEDSTRFQIINEASKVPLLAEIYGIEGNIFRLKINEETPLKPRFEVPDVLTSKPSTVRLISCSGDTGSLILADGKGDLKCHITANPFKVDLVSEEEVVISINSLGQLYFEHLQILHKQRAAKENEEETSVDTSQENQEDLGLWEEKFGKFVDIKANGPSSIGLDFSLHGFEHLYGIPQHAESHQLKNTGDGDAYRLYNLDVYGYQIYDKMGIYGSVPYLLAHKLGRTIGIFWLNASETLVEINTEPAVEYTLTQMGPVAAKQKVRSRTHVHWMSESGIIDVFLLTGPTPSDVFKQYSHLTGTQAMPPLFSLGYHQCRWNYEDEQDVKAVDAGFDEHDIPYDAMWLDIEHTEGKRYFTWDKNRFPNPKRMQELLRSKKRKLVVISDPHIKIDPDYSVYVKAKDQGFFVKNQEGEDFEGVCWPGLSSYLDFTNPKVREWYSSLFAFPVYQGSTDILFLWNDMNEPSVFRGPEQTMQKNAIHHGNWEHRELHNIYGFYHQMATAEGLIKRSKGKERPFVLTRSFFAGSQKYGAVWTGDNTAEWSNLKISIPMLLTLSITGISFCGADIGGFIGNPETELLVRWYQAGAYQPFFRGHATMNTKRREPWLFGEEHTRLIREAIRERYGLLPYWYSLFYHAHVASQPVMRPLWVEFPDELKTFDMEDEYMLGSALLVHPVTEPKATTVDVFLPGSNEVWYDYKTFAHWEGGCTVKIPVALDTIPVFQRGGSVIPIKTTVGKSTGWMTESSYGLRVALSTKGSSVGELYLDDGHSFQYLHQKQFLHRKFSFCSSVLINSFADQRGHYPSKCVVEKILVLGFRKEPSSVTTHSSDGKDQPVAFTYCAKTSILSLEKLSLNIATDWEVRII

SEQ ID NO: 47669 - protein, 282 aa, Homo sapiens
MEAAVKEEISLEDEAVDKNIFRDCNKIAFYRRQKQWLSKKSTYQALLDSVTTDEDSTRFQIINEASKVRCQDQSPTTLDAFKGKETTVQEETQDLSTRQHLAQKEAEEPDKQGQITWDISNVAPKTENFEDLLEQTPCSACLQGFTRDNTSSSFSEDAGISLSTSVKLPLASSSKPNENEALPNQPPSQQIRHNYRLLASTVSAEMARNRQLIWELARQSEAHLDRPVVLGEQASAQREVASILCRKSVLAINQLAATVEGTISVLQQFNELLDHPLDPGRS

SEQ ID NO: 47670 - protein, 409 aa, Homo sapiens
MRRYLRVVVLCVACGFCSLLYAFSQLAVSLEEGTGGGGGKPQAAVASWLAGGGRGAVRGAGVAGPAAHPGVSDRYSLKIQPVEKMHLAVVACGERLEETMTMLKSAIIFSIKPLQFHIFAEDQLHHSFKGRLDNWSFLQTFNYTLYPITFPSENAAEWKKLFKPCASQRLFLPLILKEVDSLLYVDTDILFLRPVDDIWSLLKKFNSTQIAAMAPEHEEPRIGWYNRFARHPYYGKTGVNSGVMLMNMTRMRRKYFKNDMTTVRLQWGDILMPLLKKYKLNITWGDQDLLNIVFFHNPESLFVFPCQWNYRPDHCIYGSNCQEAEEGGIFILHGNRGVYHDDKQPAFRAVYEALRNCSFEDDNIRSLLKPLELELQKTVHTYCGKIYKIFIKQLAKSVRDRYARSPKEK

SEQ ID NO: 47671 - protein, 440 aa, Homo sapiens
MRRYLRVVVLCVACGFCSLLYAFSQLAVSLEEGTGGGGGKPQAAVASWLAGGGRGAVRGAGVAGPAAHPGVSDRCKDFSLCYWNPYWMLPSDVCGMNCFWEAAFRYSLKIQPVEKMHLAVVACGERLEETMTMLKSAIIFSIKPLQFHIFAEDQLHHSFKGRLDNWSFLQTFNYTLYPITFPSENAAEWKKLFKPCASQRLFLPLILKEVDSLLYVDTDILFLRPVDDIWSLLKKFNSTQIAAMAPEHEEPRIGWYNRFARHPYYGKTGVNSGVMLMNMTRMRRKYFKNDMTTVRLQWGDILMPLLKKYKLNITWGDQDLLNIVFFHNPESLFVFPCQWNYRPDHCIYGSNCQEAEEGGIFILHGNRGVYHDDKQPAFRAVYEALRNCSFEDDNIRSLLKPLELELQKTVHTYCGKIYKIFIKQLAKSVRDRYARSPKEK

SEQ ID NO: 47672 - protein, 443 aa, Homo sapiens
MKLRSKAAALLLLALAALLLALLSLRAGRAEPPALPARPASAPQRHPAPVPARWPGPGALPGASPGVRRRRPPRPRPRAGRRGAARLEKLARRPGEPRSFQAVLPPELWIHLAVVACGNRLEETLVMLKSAVLFSHRKIQFHIFTEDSLKPEFDKQLRQWPDSYTKKFEHRIYPITFSVGNPQEWKKLFKPCAAQRLFLPVILKDVDSLLYVDTDVLFLRPVDDIWKLLRLFNSTQLAAMAPEHEIPKIGWYSRFARHPFYGSAGVNSGVMLMNLTRIRSTQFKNSMIPTGLAWEDMLYPLYQKYKNAITWGDQDLLNIIFYFNPECLYVFPCQWNYRPDHCMYGSNCREAEHEGVSVLHGNRGVYHDDKQPTFRALYEAIRDFPFQDNLFQSMYYPLQLKFLETVHTLCGRIPQVFLKQIEKTMKRAYEKHVIIHVGPNQMH

SEQ ID NO: 47673 - protein, 617 aa, Homo sapiens
MRCLAARVNYKTLIIICALFTLVTVLLWNKCSSDKAIQFPRRSSSGFRVDGFEKRAAASESNNYMNHVAKQQSEEAFPQEQQKAPPVVGGFNSNVGSKVLGLKYEEIDCLINDEHTIKGRREGNEVFLPFTWVEKYFDVYGKVVQYDGYDRFEFSHSYSKVYAQRAPYHPDGVFMSFEGYNVEVRDRVKCISGVEGVPLSTQWGPQGYFYPIQIAQYGLSHYSKNLTEKPPHIEVYETAEDRDKNKPNDWTVPKGCFMANVADKSRFTNVKQFIAPETSEGVSLQLGNTKDFIISFDLKFLTNGSVSVVLETTEKNQLFTIHYVSNAQLIAFKERDIYYGIGPRTSWSTVTRDLVTDLRKGVGLSNTKAVKPTKIMPKKVVRLIAKGKGFLDNITISTTAHMAAFFAASDWLVRNQDEKGGWPIMVTRKLGEGFKSLEPGWYSAMAQGQAISTLVRAYLLTKDHIFLNSALRATAPYKFLSEQHGVKAVFMNKHDWYEEYPTTPSSFVLNGFMYSLIGLYDLKETAGEKLGKEARSLYERGMESLKAMLPLYDTGSGTIYDLRHFMLGIAPNLARWDYHTTHINQLQLLSTIDESPVFKEFVKRWKSYLKGSRAKHN

SEQ ID NO: 47674 - protein, 553 aa, Homo sapiens
MNHVAKQQSEEAFPQEQQKAPPVVGGFNSNVGSKVLGLKYEEIDCLINDEHTIKGRREGNEVFLPFTWVEKYFDVYGKVVQYDGYDRFEFSHSYSKVYAQRAPYHPDGVFMSFEGYNVEVRDRVKCISGVEGVPLSTQWGPQGYFYPIQIAQYGLSHYSKNLTEKPPHIEVYETAEDRDKNKPNDWTVPKGCFMANVADKSRFTNVKQFIAPETSEGVSLQLGNTKDFIISFDLKFLTNGSVSVVLETTEKNQLFTIHYVSNAQLIAFKERDIYYGIGPRTSWSTVTRDLVTDLRKGVGLSNTKAVKPTKIMPKKVVRLIAKGKGFLDNITISTTAHMAAFFAASDWLVRNQDEKGGWPIMVTRKLGEGFKSLEPGWYSAMAQGQAISTLVRAYLLTKDHIFLNSALRATAPYKFLSEQHGVKAVFMNKHDWYEEYPTTPSSFVLNGFMYSLIGLYDLKETAGEKLGKEARSLYERGMESLKAMLPLYDTGSGTIYDLRHFMLGIAPNLARWDYHTTHINQLQLLSTIDESPVFKEFVKRWKSYLKGSRAKHN

SEQ ID NO: 47675 - protein, 651 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 47676 - protein, 600 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 47677 - protein, 224 aa, Homo sapiens
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMPSDMRECWLLR

SEQ ID NO: 47678 - protein, 594 aa, Homo sapiens
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMFTYEIAPVFVLMEQITLKKMREIVGWSSKDGDGIFSPGGAISNMYSIMAARYKYFPEVKTKGMAAVPKLVLFTSEQSHYSIKKAGAALGFGTDNVILIKCNERGKIIPADFEAKILEAKQKGYVPFYVNATAGTTVYGAFDPIQEIADICEKYNLWLHVDAAWGGGLLMSRKHRHKLNGIERANSVTWNPHKMMGVLLQCSAILVKEKGILQGCNQMCAGYLFQPDKQYDVSYDTGDKAIQCGRHVDIFKFWLMWKAKGTVGFENQINKCLELAEYLYAKIKNREEFEMVFNGEPEHTNVCFWYIPQSLRGVPDSPQRREKLHKVAPKIKALMMESGTTMVGYQPQGDKANFFRMVISNPAATQSDIDFLIEEIERLGQDL

SEQ ID NO: 47679 - protein, 224 aa, Homo sapiens; identical to SEQ ID NO: 47677

SEQ ID NO: 47680 - protein, 37 aa, Homo sapiens
MASSTPSSSATSSNAGADPNTTNLRPTTYDTWCGVAH

SEQ ID NO: 47681 - protein, 85 aa, Homo sapiens
MASSTPSSSATSSNAGADPNTTNLRPTTYDTWCGVAHGCTRKLGLKICGFLQRTNSLEEKSRLVSAFKERQSSKNLLSCENSDRD

SEQ ID NO: 47682 - protein, 115 aa, Homo sapiens
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQ

SEQ ID NO: 47683 - protein, 121 aa, Homo sapiens
MASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVV

SEQ ID NO: 47684 - protein, 585 aa, Homo sapiens
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 47685 - protein, 129 aa, Homo sapiens
MNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGT

SEQ ID NO: 47686 - protein, 585 aa, Homo sapiens; identical to SEQ ID NO: 47684

SEQ ID NO: 47687 - protein, 188 aa, Homo sapiens
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGIVSSKIIKLFFRLQ

SEQ ID NO: 47688 - protein, 558 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 47689 - protein, 515 aa, Homo sapiens
MYRYLGPGTARRRPAAGAGIGRPAPLQRGGGRPRGRPQLLQDGGGLLRSRRQHRGGQAGGGPEDPGERGAEAEPGARHPADHQALQPCAESLLPQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 47690 - protein, 490 aa, Homo sapiens [sequence omitted]

SEQ ID NO: 47691 - protein, 257 aa, Homo sapiens
ENFIVEGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 47692 - protein, 391 aa, Homo sapiens
MTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 47693 - protein, 425 aa, Homo sapiens
MTCPCDNASSVFLGFCIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 47694 - protein, 558 aa, Homo sapiens
MYRYLAKALLPSRAGPAALGSAANHSAALLGRGRGQPAAASQPGLALAARRHYSELVADREDDPNFFKMVEGFFDRGASIVEDKLVKDLRTQESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTENELEKITRRFTMELAKKGFIGPGVDVPAPDMNTGEREMSWIADTYASTIGHYDINAHACVTGKPISQGGIHGRISATGRGVFHGIENFINEASYMSILGMTPGFRDKTFVVQGFGNVGLHSMRYLHRFGAKCIAVGESDGSIWNPDGIDPKELEDFKLQHGSILGFPKAKPYEGSILEVDCDILIPAATEKQLTKSNAPRVKAKIIAEGANGPTTPEADKIFLERNILVIPDLYLNAGGVTVSYFEWLKNLNHVSYGRLTFKYERDSNYHLLLSVQESLERKFGKHGGTIPIVPTAEFQDSISGASEKDIVHSALAYTMERSARQIMHTAMKYNLGLDLRTAAYVNAIEKVFKVYSEAGVTFT

SEQ ID NO: 47695 - protein, 1113 aa, Homo sapiens
MIAVSFKCRCQILRRLTKDESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHVKIQRSDRQLTWDSWASNHSSLHTNHHYNTYHPDHCRVPALTFPKAPPPNSPPALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 47696 - protein, 1128 aa, Homo sapiens
MIAVSFKCRCQILRRLTKDESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHVKIQRSDRQLTWDSWASNHSSLHTNHHYNTYHPDHCRVPALTFPKAPPPNSPPALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEEKADRRVSLRNMTLLATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 47697 - protein, 1076 aa, Homo sapiens
MIAVSFKCRCQILRRLTKDESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHAALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEEKADRRVSLRNMTLLATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 47698 - protein, 836 aa, Homo sapiens
MVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 47699 - protein, 901 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQSTGGGRGALQNQKDTVLPRRAIEREEGQLQLCSRHRES

SEQ ID NO: 47700 - protein, 885 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQQYHPTDITGPLNLSDPSVSTVV

SEQ ID NO: 47701 - protein, 922 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNNCIPPVRKSVQKSVTWYTIPPTV

SEQ ID NO: 47702 - protein, 894 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRNAVNLAVLKLNEQGLLDKLKNKWWYDKGECGSGGGDSKDKTSALSLSNVAGVFYILVGGLGLAMMVALIEFCYKSRAESKRMKLTKNTQNFKPAPATNTQNYATYREGYNVYGTESVKI

SEQ ID NO: 47703 - protein, 143 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNACPAERDYLPWPGSIRENNWTALPCCKDHGLLHLKCSPGGRQNWAYCIWGVTGEL

SEQ ID NO: 47704 - protein, 894 aa, Homo sapiens; identical to SEQ ID NO: 47702

SEQ ID NO: 47705 - protein, 894 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRTPVNLAVLKLSEQGILDKLKNKWWYDKGECGAKDSGSKDKTSALSLSNVAGVFYILVGGLGLAMMVALIEFCYKSRAESKRMKLTKNTQNFKPAPATNTQNYATYREGYNVYGTESVKI

SEQ ID NO: 47706 - protein, 164 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNACPAERDYLPWPGSIRENNWTALPCCKDHGLLHLKCSPGGPAKTGPIVSGALQVNCKMRTRSQVSTTSSLLEFSTE

SEQ ID NO: 47707 - protein, 164 aa, Homo sapiens; identical to SEQ ID NO: 47706

SEQ ID NO: 47708 - protein, 662 aa, Homo sapiens
MLQGGEESRLFGSLLWTLPWRGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRFVFVAYSMPHCILWSYSIHVHMVFIHLNSRFFSFNIPSNDRLSSSHCVCLCP

SEQ ID NO: 47709 - protein, 824 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRNAVNLAVLKLNEQGLLDKLKNKWWYDKGECGSGGGDSKNACKPCSIETQ

SEQ ID NO: 47710 - protein, 902 aa, Homo sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNEYIEQRKPCDTMKVGGNLDSKGYGVATPKGSSLRTPVNLAVLKLSEAGVLDKLKNKWWYDKGECGPKDSGSKDKTSALSLSNVAGVFYILVGGLGLAMLVALIEFCYKSRAEAKRMKLTFSEAIRNKARLSITGSVGENGRVLTPDCPKAVHTGTAIRQSSGLAVIASDLP

SEQ ID NO: 47711 - protein, 433 aa, Homo sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMPLMKNPILRN

SEQ ID NO: 47712 - protein, 884 aa, Homo sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNEYIEQRKPCDTMKVGGNLDSKGYGVATPKGSSLRNAVNLAVLKLNEQGLLDKLKNKWWYDKGECGSGGGDSKDKTSALSLSNVAGVFYILVGGLGLAMLVALIEFCYKSRAEAKRMKVAKSAQTFNPTSSQNTQNLATYREGYNVYGTESIKI

SEQ ID NO: 47713 - protein, 433 aa, Homo sapiens; identical to SEQ ID NO: 47711

SEQ ID NO: 47714 - protein, 884 aa, Homo sapiens; identical to SEQ ID NO: 47712

SEQ ID NO: 47715 - protein, 82 aa, Homo sapiens
MRIISRQIVLLFSGFWGLAMGAFPSSVQIGGLFIRNTDQEYTAFRLAIFLHNTSPNASEAPFNLVPHVDNIETANSFAVTNA

SEQ ID NO: 47716 - protein, 82 aa, Homo sapiens; identical to SEQ ID NO: 47715

SEQ ID NO: 47717 - protein, 902 aa, Homo sapiens; identical to SEQ ID NO: 47710

SEQ ID NO: 47718 - protein, 119 aa, Homo sapiens
MRSAEPSVFTRTTAEGVARVRKSKGKFAFLLESTMNEYIEQRKPCDTMKVGGNLDSKGYGVATPKGSSLRNAVNLAVLKLNEQGLLDKLKNKWWYDKGECGSGGGDSKNSCKPCRFETQ

SEQ ID NO: 47719 - protein, 906 aa, Homo sapiens
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 47720 - protein, 906 aa, Homo sapiens
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRGPVNLAVLKLSEQGVLDKLKSKWWYDKGECGSKDSGSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 47721 - protein, 916 aa, Homo sapiens
MCCSTHLFQPLQLAGGLEWPWSNLLCFLTPVKLHPEVWGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRGPVNLAVLKLSEQGVLDKLKSKWWYDKGECGSKDSGSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 47722 - protein, 826 aa, Homo sapiens
MQHIFAFFCTGFLGAVVGANFPNNIQIGGLFPNQQSQEHAAFRFALSQLTEPPKLLPQIDIVNISDSFEMTYRCLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 47723 - protein, 916 aa, Homo sapiens
MCCSTHLFQPLQLAGGLEWPWSNLLCFLTPVKLHPEVWGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 47724 - protein, 716 aa, Homo sapiens
MQHIFAFFCTGFLGAVVGANFPNNIQIVCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRTRQAL

SEQ ID NO: 47725 - protein, 906 aa, Homo sapiens; identical to SEQ ID NO: 47720

SEQ ID NO: 47726 - protein, 837 aa, Homo sapiens
MTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 47727 - protein, 883 aa, Homo sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKEKTSALSLSNVAGVFYILVGGLGLAMLVALIEFCYKSRAEAKRMKVAKNAQNINPSSSQNSQNFATYKEGYNVYGIESVKI

SEQ ID NO: 47728 - protein, 883 aa, Homo sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 47729 - protein, 730 aa, Homo sapiens
MVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLSGVTFKTLLFVCCG

SEQ ID NO: 47730 - protein, 98 aa, Homo sapiens
MNEYIEQRKPCDTMKVGGNLDSKGYGIATPKGSSLSGVTFKTLICLLWINAVNLAVLKLNEQGLLDKLKNKWWYDKGECGSGGGDSKNPSKSCSIETQ

SEQ ID NO: 47731 - protein, 836 aa, Homo sapiens; identical to SEQ ID NO: 47698

SEQ ID NO: 47732 - protein, 145 aa, Homo sapiens
MVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMY

SEQ ID NO: 47733 - protein, 57 aa, Homo sapiens
MVQFSTSEFRLTPHIDNLEVANSFAVTNAFCSQFSRGVYAIFGFYDKKSVNTITSFC

SEQ ID NO: 47734 - protein, 836 aa, Homo sapiens; identical to SEQ ID NO: 47698

SEQ ID NO: 47735 - protein, 125 aa, Homo sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFV

SEQ ID NO: 47736 - protein, 48 aa, Homo sapiens
MQKIMHISVLLSPVLWGLIFGVSSNSIQIGGLFPRGADQEYSAFRVGM

SEQ ID NO: 47737 - protein, 1009 aa, Homo sapiens
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGVLPEALDTSHGTSI

SEQ ID NO: 47738 - protein, 580 aa, Homo sapiens
MGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGVLPEALDTSHGTSI

SEQ ID NO: 47739 - protein, 1007 aa, Homo sapiens
MEVFPFLLVLSVWWSRTWDSANADSIIHIGAIFDESAKKDDEVFRTAVGDLNQNEEILQTEKITFSVTFVDGNNPFQAVQEACELMNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAINDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 47740 - protein, 912 aa, Homo sapiens
MEVFPFLLVLSVWWSRTWDSANADSIIHIGAIFDESAKKDDEVFRTAVGDLNQNEEILQTEKITFSVTFVDGNNPFQAVQEDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAINDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 47741 - protein, 920 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEATARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 47742 - protein, 949 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQKGKSSRIRFYFRNKVRFHGRKKQSLGVEKCLSFNAIMEELGISLKNQKKIKKKSRTKGKSSFTSILTCHQRRTQRKETVA

SEQ ID NO: 47743 - protein, 871 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQHY

SEQ ID NO: 47744 - protein, 905 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQKKIKKKSRTKGKSSFTSILTCHQRRTQRKETVA

SEQ ID NO: 47745 - protein, 918 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 47746 - protein, 903 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 47747 - protein, 920 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQKKIKKKSRTKGKSSFTSILTCHQRRTQRKETVA

SEQ ID NO: 47748 - protein, 934 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQKGKSSRIRFYFRNKVRFHGRKKQSLGVEKCLSFNAIMEELGISLKNQKKIKKKSRTKGKSSFTSILTCHQRRTQRKETVA

SEQ ID NO: 47749 - protein, 922 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEATARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQKKIKKKSRTKGKSSFTSILTCHQRRTQRKETVA

SEQ ID NO: 47750 - protein, 748 aa, Homo sapiens
MEHGTLLAQPGLWTRDTSWALLYFLCYILPQTAPQVLRIACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQ

SEQ ID NO: 47751 - protein, 869 aa, Homo sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKESSIWLVPPYHPDTV

SEQ ID NO: 47752 - protein, 859 aa, Homo sapiens
MGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 47753 - protein, 832 aa, Homo sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 47754 - protein, 892 aa, Homo sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRAKTKLPQDYVFLPILESVSISTVLSSSPSSSSLSSCS

SEQ ID NO: 47755 - protein, 584 aa, Homo sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARF

SEQ ID NO: 47756 - protein, 869 aa, Homo sapiens; identical to SEQ ID NO: 47751

SEQ ID NO: 47757 - protein, 908 aa, Homo sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 47758 - protein, 644 aa, Homo sapiens
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKESSIWLVPPYHPDTV

SEQ ID NO: 47759 - protein, 919 aa, Homo sapiens [sequence omitted]

SEQ ID NO: 47760 - protein, 872 aa, Homo sapiens
MTAPWRRLRSLVWEYWAGLLVCAFWIPDSRGMPHVIRIGGIFEYADGPNAQVMNAEEHAFRFSANIINRNRTLLPNTTLTYDIQRIHFHDSFEATKKACDQLALGVVAIFGPSQGSCTNAVQSICNALEVPHIQLRWKHHPLDNKDTFYVNLYPDYASLSHAILDLVQYLKWRSATVVYDDSTGLIRLQELIMAPSRYNIRLKIRQLPIDSDDSRPLLKEMKRGREFRIIFDCSHTMAAQILKQAMAMGMMTEYYHFIFTTLDLYALDLEPYRYSGVNLTGFRILNVDNPHVSAIVEKWSMERLQAAPRSESGLLDGVMMTDAALLYDAVHIVSVCYQRAPQMTVNSLQCHRHKAWRFGGRFMNFIKEAQWEGLTGRIVFNKTSGLRTDFDLDIISLKEDGLEKVGVWSPADGLNITEVAKGRGPNVTDSLTNRSLIVTTVLEEPFVMFRKSDRTLYGNDRFEGYCIDLLKELAHILGFSYEIRLVEDGKYGAQDDKGQWNGMVKELIDHKADLAVAPLTITHVREKAIDFSKPFMTLGVSILYRKPNGTNPSVFSFLNPLSPDIWMYVLLAYLGVSCVLFVIARFSPYEWYDAHPCNPGSEVVENNFTLLNSFWFGMGSLMQQGSELMPKALSTRIIGGIWWFFTLIIISSYTANLAAFLTVERMESPIDSADDLAKQTKIEYGAVKDGATMTFFKKSKISTFEKMWAFMSSKPSALVKNNEEGIQRALTADYALLMESTTIEYVTQRNCNLTQIGGLIDSKGYGIGTPMGSPYRDKITIAILQLQEEDKLHIMKEKWWRGSGCPEEENKEASALGIQKIGGIFIVLAAGLVLSVLVAVGEFVYKLRKTAEREQVSLRAWSLHRMGNGDSR

SEQ ID NO: 47761 - protein, 956 aa, Homo sapiens
MPRVSAPLVLLPAWLVMVACSPHSLRIAAILDDPMECSRGERLSITLAKNRINRAPERLGKAKVEVDIFELLRDSEYETAETMCQILPKGVVAVLGPSSSPASSSIISNICGEKEVPHFKVAPEEFVKFQFQRFTTLNLHPSNTDISVAVAGILNFFNCTTACLICAKAECLLNLEKLLRQFLISKDTLSVRMLDDTRDPTPLLKEIRDDKTATIIIHANASMSHTILLKAAELGMVSAYYTYIFTNLEFSLQRMDSLVDDRVNILGFSIFNQSHAFFQEFAQSLNQSWQENCDHVPFTGPALSSALLFDAVYAVVTAVQELNRSQEIGVKPLSCGSAQIWQHGTSLMNYLRMVELEGLTGHIEFNSKGQRSNYALKILQFTRNGFRQIGQWHVAEGLSMDSHLYASNISDTLFNTTLVVTTILENPYLMLKGNHQEMEGNDRYEGFCVDMLKELAEILRFNYKIRLVGDGVYGVPEANGTWTGMVGELIARKADLAVAGLTITAEREKVIDFSKPFMTLGISILYRVHMGRKPGYFSFLDPFSPGVWLFMLLAYLAVSCVLFLVARLTPYEWYSPHPCAQGRCNLLVNQYSLGNSLWFPVGGFMQQGSTIAPRALSTRCVSGVWWAFTLIIISSYTANLAAFLTVQRMDVPIESVDDLADQTAIEYGTIHGGSSMTFFQNSRYQTYQRMWNYMYSKQPSVFVKSTEEGIARVLNSNYAFLLESTMNEYYRQRNCNLTQIGGLLDTKGYGIGMPVGSVFRDEFDLAILQLQENNRLEILKRKWWEGGKCPKEEDHRAKGLGMENIGGIFVVLICGLIVAIFMAMLEFLWTLRHSEATEVSVCQEMVTELRSIILCQDSIHPRRRRAAVPPPRPPIPEERRPRGTATLSNGKLCGAGEPDQLAQRLAQEAALVARGCTHIRVCPECRRFQGLRARPSPARSEESLEWEKTTNSSEPE

SEQ ID NO: 47762 - protein, 956 aa, Homo sapiens; identical to SEQ ID NO: 47761

SEQ ID NO: 47763 - protein, 980 aa, Homo sapiens
MPAELLLLLIVAFASPSCQVLSSLRMAAILDDQTVCGRGERLALALAREQINGIIEVPAKARVEVDIFELQRDSQYETTDTMCQILPKGVVSVLGPSSSPASASTVSHICGEKEIPHIKVGPEETPRLQYLRFASVSLYPSNEDVSLAVSRILKSFNYPSASLICAKAECLLRLEELVRGFLISKETLSVRMLDDSRDPTPLLKEIRDDKVSTIIIDANASISHLILRKASELGMTSAFYKYILTTMDFPILHLDGIVEDSSNILGFSMFNTSHPFYPEFVRSLNMSWRENCEASTYLGPALSAALMFDAVHVVVSAVRELNRSQEIGVKPLACTSANIWPHGTSLMNYLRMVEYDGLTGRVEFNSKGQRTNYTLRILEKSRQGHREIGVWYSNRTLAMNATTLDINLSQTLANKTLVVTTILENPYVMRRPNFQALSGNERFEGFCVDMLRELAELLRFRYRLRLVEDGLYGAPEPNGSWTGMVGELINRKADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPVGGFMQQGSEIMPRALSTRCVSGVWWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEEVSVCQEMLQELRHAVSCRKTSRSRRRRRPGGPSRALLSLRAVREMRLSNGKLYSAGAGGDAGSAHGGPQRLLDDPGPPSGARPAAPTPCTHVRVCQECRRIQALRASGAGAPPRGLGVPAEATSPPRPRPGPAGPRELAEHE

SEQ ID NO: 47764 - protein, 981 aa, Homo sapiens
MPAELLLLLIVAFASPSCQVLSSLRMAAILDDQTVCGRGERLALALAREQINGIIEVPAKARVEVDIFELQRDSQYETTDTMCQILPKGVVSVLGPSSSPASASTVSHICGEKEIPHIKVGPEETPRLQYLRFASVSLYPSNEDVSLAVSRILKSFNYPSASLICAKAECLLRLEELVRGFLISKETLSVRMLDDSRDPTPLLKEIRDDKVSTIIIDANASISHLILRKASELGMTSAFYKYILTTMDFPILHLDGIVEDSSNILGFSMFNTSHPFYPEFVRSLNMSWRENCEASTYLGPALSAALMFDAVHVVVSAVRELNRSQEIGVKPLACTSANIWPHGTSLMNYLRMVEYDGLTGRVEFNSKGQRTNYTLRILEKSRQGHREIGVWYSNRTLAMNATTLDINLSQTLANKTLVVTTILENPYVMRRPNFQALSGNERFEGFCVDMLRELAELLRFRYRLRLVEDGLYGAPEPNGSWTGMVGELINRKADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPVGGFMQQGSEIMPRALSTRCVSGVWWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEETPALHPAACQCSALGPRTPLKEPSMLLVKVPSTRVQVAFSRTSLRQVCPFLLQHQLSSLYWIQATNVQICCHFSSLKPSPDLTFPPSHRPLSSLLFTALAAVGGLPDASSFFFPPISSCPPLQSGIGPCHSTEATLVTSNFHV

SEQ ID NO: 47765 - protein, 358 aa, Homo sapiens
  MOD_RES (1)..(1): Any amino acid
XWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEETPALHPAACQCSALGPRTPLKEPSMLLVKVPSTRVQVAFSRTSLRQVCPFLLQHQLSSLYWIQATNVQICCHFSSLKPSPDLTFPPSHRPLSSLLFTALAAVGGLPDASSFFFPPISSCPPLQSGIGPCHSTEATLVTSNFHV

SEQ ID NO: 47766 - protein, 922 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 47767 - protein, 909 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQVGQATLRGLVPRARPGHGPPPSPKAVALALALVGRTGARSHGQGQW

SEQ ID NO: 47768 - protein, 943 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTQYHPTDITGPLNLSDPSVSTVV

SEQ ID NO: 47769 - protein, 922 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQSTGGGRGALQNQKDTVLPRRAIEREEGQLQLCSRHRES

SEQ ID NO: 47770 - protein, 906 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKSKKRNYENLDQLSYDNKRGPKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQQYHPTDITGPLNLSDPSVSTVV

SEQ ID NO: 47771 - protein, 938 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 47772 - protein, 1464 aa, Homo sapiens [sequence omitted]

SEQ ID NO: 47773 - protein, 1464 aa, Homo sapiens [sequence omitted]

SEQ ID NO: 47774 - protein, 1464 aa, Homo sapiens [sequence omitted]

SEQ ID NO: 47775 - protein, 1281 aa, Homo sapiens
MGRVGYWTLLVLPALLVWRGPAPSAAAEKGPPALNIAVMLGHSHDVTERELRTLWGPEQAAGLPLDVNVVALLMNRTDPKSLITHVCDLMSGARIHGLVFGDDTDQEAVAQMLDFISSHTFVPILGIHGGASMIMADKDPTSTFFQFGASIQQQATVMLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSIVTLEEAPFVIVEDIDPLTETCVRNTVPCRKFVKINNSTNEGMNVKKCCKGFCIDILKKLSRTVKFTYDLYLVTNGKHGKKVNNVWNGMIGEVVYQRAVMAVGSLTINEERSEVVDFSVPFVETGISVMVSRSNGTVSPSAFLEPFSASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGMTNAWLLGDAPRTLTNTRCHPRR

SEQ ID NO: 47776 - protein, 1124 aa, Homo sapiens
MLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSIVTLEEAPFVIVEDIDPLTETCVRNTVPCRKFVKINNSTNEGMNVKKCCKGFCIDILKKLSRTVKFTYDLYLVTNGKHGKKVNNVWNGMIGEVVYQRAVMAVGSLTINEERSEVVDFSVPFVETGISVMVSRSNGTVSPSAFLEPFSASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGMTNAWLLGDAPRTLTNTRCHPRR

SEQ ID NO: 47777 - protein, 1484 aa, Homo sapiens [sequence omitted]

SEQ ID NO: 47778 - protein, 1233 aa, Homo sapiens
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 47779 - protein, 907 aa, Homo sapiens
RGQGGDTRSKGTRQPEPPGASRDPARSCWDPPVDMGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRVGAHPSPHRPKF

SEQ ID NO: 47780 - protein, 1336 aa, Homo sapiens
MRGAGGPRGPRGPAKMLLLLALACASPFPEEAPGPGGAGGPGGGLGGARPLNVALVFSGPAYAAEAARLGPAVAAAVRSPGLDVRPVALVLNGSDPRSLVLQLCDLLSGLRVHGVVFEDDSRAPAVAPILDFLSAQTSLPIVAVHGGAALVLTPKEKGSTFLQLGSSTEQQLQVIFEVLEEYDWTSFVAVTTRAPGHRAFLSYIEVLTDGSLVGWEHRGALTLDPGAGEAVLSAQLRSVSAQIRLLFCAREEAEPVFRAAEEAGLTGSGYVWFMVGPQLAGGGGSGAPGEPPLLPGGAPLPAGLFAVRSAGWRDDLARRVAAGVAVVARGAQALLRDYGFLPELGHDCRAQNRTHRGESLHRYFMNITWDNRDYSFNEDGFLVNPSLVVISLTRDRTWEVVGSWEQQTLRLKYPLWSRYGRFLQPVDDTQHLTVATLEERPFVIVEPADPISGTCIRDSVPCRSQLNRTHSPPPDAPRPEKRCCKGFCIDILKRLAHTIGFSYDLYLVTNGKHGKKIDGVWNGMIGEVFYQRADMAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLAAFMIQEEYVDTVSGLSDRKFQRPQEQYPPLKFGTVPNGSTEKNIRSNYPDMHSYMVRYNQPRVEEALTQLKAGKLDAFIYDAAVLNYMARKDEGCKLVTIGSGKVFATTGYGIALHKGSRWKRPIDLALLQFLGDDEIEMLERLWLSGICHNDKIEVMSSKLDIDNMAGVFYMLLVAMGLSLLVFAWEHLVYWRLRHCLGPTHRMDFLLAFSRGMYSCCSAEAAPPPAKPPPPPQPLPSPAYPAPRPAPGPAPFVPRERASVDRWRRTKGAGPPGGAGLADGFHRYYGPIEPQGLGLGLGEARAAPRGAAGRPLSPPAAQPPQKPPPSYFAIVRDKEPAEPPAGAFPGFPSPPAPPAAAATAVGPPLCRLAFEDESPPAPARWPRSDPESQPLLGPGAGGAGGTGGAGGGAPAAPPPCRAAPPPCPYLDLEPSPSDSEDSESLGGASLGGLEPWWFADFPYPYAERLGPPPGRYWSVDKLGGWRAGSWDYLPPRSGPAAWHCRHCASLELLPPPRHLSCSHDGLDGGWWAPPPPPWAAGPLPRRRARCGCPRSHPHRPRASHRTPAAAAPHHHRHRRAAGGWDLPPPAPTSRSLEDLSSCPRAAPARRLTGPSRHARRCPHAAHWGPPLPTASHRRHRGGDLGTRRGSAHFSSLESEV

SEQ ID NO: 47781 - protein, 371 aa, Homo sapiens
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 47782 - protein, 371 aa, Homo sapiens; identical to SEQ ID NO: 47781

SEQ ID NO: 47783 - protein, 274 aa, Homo sapiens
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQ

SEQ ID NO: 47784 - protein, 101 aa, Homo sapiens
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQ

SEQ ID NO: 47785 - protein, 352 aa, Homo sapiens
MSHEKSFLVSGDNYPPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 47786 - protein, 1115 aa, Homo sapiens
MRRLSLWWLLSRVCLLLPPPCALVLAGVPSSSSHPQPCQILKRIGHAVRVGAVHLQPWTTAPRAASRAPDDSRAGAQRDEPEPGTRRSPAPSPGARWLGSTLHGRGPPGSRKPGEGARAEALWPRDALLFAVDNLNRVEGLLPYNLSLEVVMAIEAGLGDLPLLPFSSPSSPWSSDPFSFLQSVCHTVVVQGVSALLAFPQSQGEMMELDLVSLVLHIPVISIVRHEFPRESQNPLHLQLSLENSLSSDADVTVSILTMNNWYNFSLLLCQEDWNITDFLLLTQNNSKFHLGSIINITANLPSTQDLLSFLQIQLESIKNSTPTVVMFGCDMESIRRIFEITTQFGVMPPELRWVLGDSQNVEELRTEGLPLGLIAHGKTTQSVFEHYVQDAMELVARAVATATMIQPELALIPSTMNCMEVETTNLTSGQYLSRFLANTTFRGLSGSIRVKGSTIVSSENNFFIWNLQHDPMGKPMWTRLGSWQGGKIVMDYGIWPEQAQRHKTHFQHPSKLHLRVVTLIEHPFVFTREVDDEGLCPAGQLCLDPMTNDSSTLDSLFSSLHSSNDTVPIKFKKCCYGYCIDLLEKIAEDMNFDFDLYIVGDGKYGAWKNGHWTGLVGDLLRGTAHMAVTSFSINTARSQVIDFTSPFFSTSLGILVRTRDTAAPIGAFMWPLHWTMWLGIFVALHITAVFLTLYEWKSPFGLTPKGRNRSKVFSFSSALNICYALLFGRTVAIKPPKCWTGRFLMNLWAIFCMFCLSTYTANLAAVMVGEKIYEELSGIHDPKLHHPSQGFRFGTVRESSAEDYVRQSFPEMHEYMRRYNVPATPDGVEYLKNDPEKLDAFIMDKALLDYEVSIDADCKLLTVGKPFAIEGYGIGLPPNSPLTANISELISQYKSHGFMDMLHDKWYRVVPCGKRSFAVTETLQMGIKHFSGLFVLLCIGFGLSILTTIGEHIVYRLLLPRIKNKSKLQYWLHTSQRLHRAINTSFIEEKQQHFKTKRVEKRSNVGPRQLTVWNTSNLSHDNRRKYIFSDEEGQNQLGIRIHQDIPLPPRRRELPALRTTNGKADSLNVSRNSVMQELSELEKQIQVIRQELQLAVSRKTELEEYQRTSRTCES

SEQ ID NO: 47787 - protein, 1194 aa, Homo sapiens
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNANSNGKSVSWSEPGGGQVPKGQHMWHRLSVHVKTNETACNQTAVIKPLTKSYQGSGKSLTFSDTSTKTLYNVEEEEDAQPIRFSPPGSPSMVVHRRVPSAATTPPLPSHLTAEETPLFLAEPALPKGLPPPLQQQQQPPPQQKSLMDQLQGVVSNFSTAIPDFHAVLAGPGGPGNGLRSLYPPPPPPQHLQMLPLQLSTFGEELVSPPADDDDDSERFKLLQEYVYEHEREGNTEEDELEEEEEDLQAASKLTPDDSPALTPPSPFRDSVASGSSVPSSPVSESVLCTPPNVSYASVILRDYKQSSSTL

SEQ ID NO: 47788 - protein, 1194 aa, Homo sapiens; identical to SEQ ID NO: 47787

SEQ ID NO: 47789 - protein, 906 aa, Homo sapiens
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNAKKRQPEFSPTSQCPSAHVQL

SEQ ID NO: 47790 - protein, 906 aa, Homo sapiens; identical to SEQ ID NO: 47789

SEQ ID NO: 47791 - protein, 906 aa, Homo sapiens; identical to SEQ ID NO: 47789

SEQ ID NO: 47792 - protein, 872 aa, Homo sapiens [sequence omitted]

SEQ ID NO: 47793 - protein, 70 aa, Homo sapiens [sequence omitted]

SEQ ID NO: 47794 - protein, 879 aa, Homo sapiens
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 47795 - protein, 535 aa, Homo sapiens
MLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTGADDNHVHLCQPEWLCGLGLFVCTQGSHHPVSTPEECCHTQTAPQQVQCQWNWDHILSVLCKHVCANGVQWAGSPRLHHLISVIVNCSSVLVFLDC

SEQ ID NO: 47796 - protein, 87 aa, Homo sapiens
MKMLTRLQVLTLALFSKGFLLSLGDHNFLRREIKIEGDLVLGGLFPINEKGTGTEECGRINEDRGIQRLEAMLFAIDEINKDDYLLP

SEQ ID NO: 47797 - protein, 537 aa, Homo sapiens
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTGADDNHVHLCQPEWLCGLGLFVCTQGSHHPVSTPEECCHTQTAPQQVQCQWNWDHILSVLCKHVCANGVQWAGSPRLHHLISVIVNCSSVLVFLDC

SEQ ID NO: 47798 - protein, 81 aa, Homo sapiens
MKMLTRLQVLTLALFSKGFLLSLGDHNFLRREIKIEGDLVLGGLFPINEKGTGTEECGRINEDRGIQRLEAMLFAIDEINK

SEQ ID NO: 47799 - protein, 751 aa, Homo sapiens
MSQSPGAGSPPPLPPRSAPVPARSCRCEVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 47800 - protein, 471 aa, Homo sapiens
MRRTNHEPEPGCRLTAAAATAVSSSSCQELSVRAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 47801 - protein, 796 aa, Homo sapiens
MPAWEPGVAASCGWRAPPCSPLRLCIAPHPCTPPSSHQGNLTCRLPPRSFGFCRCVWVRTRGPSLPGEQVSLAAHESEGAAAQLGSSPEIDPRRPRCLLPESAQIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRDRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 47802 - protein, 912 aa, Homo sapiens
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 47803 - protein, 772 aa, Homo sapiens
MVQTLPKLFPHDGAKRKKRTLRTSGPCFGGGGQIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 47804 - protein, 779 aa, Homo sapiens
MAVPLGAPCWASALPAWAPPGLPHRSLLTRLLSQHVKPAKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 47805 - protein, 912 aa, Homo sapiens; identical to SEQ ID NO: 47802

SEQ ID NO: 47806 - protein, 743 aa, Homo sapiens
MSCKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 47807 - protein, 591 aa, Homo sapiens
MGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPGSS

SEQ ID NO: 47808 - protein, 877 aa, Homo sapiens
MARPRRAREPLLVALLPLAWLAQAGLARAAGSVRLAGGLTLGGLFPVHARGAAGRACGQLKKEQGVHRLEAMLYALDRVNADPELLPGVRLGARLLDTCSRDTYALEQALSFVQALIRGRGDGDEVGVRCPGGVPPLRPAPPERVVAVVGASASSVSIMVANVLRLFAIPQISYASTAPELSDSTRYDFFSRVVPPDSYQAQAMVDIVRALGWNYVSTLASEGNYGESGVEAFVQISREAGGVCIAQSIKIPREPKPGEFSKVIRRLMETPNARGIIIFANEDDIRRVLEAARQANLTGHFLWVGSDSWGAKTSPILSLEDVAVGAITILPKRASIDGFDQYFMTRSLENNRRNIWFAEFWEENFNCKLTSSGTQSDDSTRKCTGEERIGRDSTYEQEGKVQFVIDAVYAIAHALHSMHQALCPGHTGLCPAMEPTDGRMLLQYIRAVRFNGSAGTPVMFNENGDAPGRYDIFQYQATNGSASSGGYQAVGQWAETLRLDVEALQWSGDPHEVPSSLCSLPCGPGERKKMVKGVPCCWHCEACDGYRFQVDEFTCEACPGDMRPTPNHTGCRPTPVVRLSWSSPWAAPPLLLAVLGIVATTTVVATFVRYNNTPIVRASGRELSYVLLTGIFLIYAITFLMVAEPGAAVCAARRLFLGLGTTLSYSALLTKTNRIYRIFEQGKRSVTPPPFISPTSQLVITFSLTSLQVVGMIAWLGARPPHSVIDYEEQRTVDPEQARGVLKCDMSDLSLIGCLGYSLLLMVTCTVYAIKARGVPETFNEAKPIGFTMYTTCIIWLAFVPIFFGTAQSAEKIYIQTTTLTVSLSLSASVSLGMLYVPKTYVILFHPEQNVQKRKRSLKATSTVAAPPKGEDAEAHK

SEQ ID NO: 47809 - protein, 1091 aa, Homo sapiens
MQLDGLQALCWGSLFRTQLVPVYVAVLPSPQPCIPPTCTAFTEFSGPLAKHHSFQPFQVAAPAGPRSPPQPFHLPSVSQVHATHLLCPVRVLGPPYPPSLELLTSIHSPAVLPAPQIPQISYASTAPELSDSTRYDFFSRVVPPDSYQAQAMVDIVRALGWNYVSTLASEGNYGESGVEAFVQISREAGELGAPRHQGVYIVWARGPQLGQKQKDGGPRSMLGRGCLAGAPCGRDLFVLDDSALPQAWRRVQARLHPCRPFSQPTQSSAAVARWSIKIPREPKPGEFSKVIRRLMETPNARGIIIFANEDDISPAPTRRVLEAARQANLTGHFLWVGSDSWGAKTSPILSLEDVAVGAITILPKRASIDGFDQYFMTRSLENNRRNIWFAEFWEENFNCKLTSSGTQSDDSTRKCTGESCPGWTGEERIGRDSTYEQEGKVQFVIDAVYAIAHALHSMHQALCPGHTGLCPAMEPTDGRMLLQYIRCPLQWLNRIPLCEWPRRVRPFFCQWTLGLLSSCGYVNNAAVNVAVQAFLATLLSSLSSIYPGVELLGHVFNLLRRLHTVFCSGCSLFPPTVHKGSAGTPVMFNENGDAPGRYDIFQYQATNGSASSGGYQAVGQWAETLRLDVSVQTEPQVGMGPGSRRQTPQPVFCASQVEALQWSGDPHEVPSSLCSLPCGPGERKKMVKGVPCCWHCEACDGYRFQVDEFTCEACPGDMRPTPNHTGCRPTPVVRLSWSSPWAAPPLLLAVLGIVATTTVVATFVRYNNTPIVRASGRELSYVLLTGIFLIYAITFLMVAEPGAAVCAARRLFLGLGTTLSYSALLTKTNRIYRIFEQGKRSVTPPPFISPTSQLVITFSLTSLQINAVFRVTLFYFGSLQWHYLSSLQALPSGDLSVQHLSASVSLGMLYSKSKTPVDLEVGSEPWGYLGDGVLQAEHWGEGRGDWPHVKVMVVVYQSSLVYYMKQAQAGRVKTELLKVAHHQVAKSVPEESQIVVLHLVTAGYVDMAIRTTRASLHLMPLTLVPGAAAEVNETQVAARLGPGSTVGTYQVVVVLMRSLQIDKTTNQLSLETCFSGIQGFLASVNSLVMDK

SEQ ID NO: 47810 - protein, 877 aa, Homo sapiens; identical to SEQ ID NO: 47808

SEQ ID NO: 47811 - protein, 915 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 47812 - protein, 906 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSEKCNCY

SEQ ID NO: 47813 - protein, 922 aa, Homo sapiens; identical to SEQ ID NO: 47701

SEQ ID NO: 47814 - protein, 911 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNITSEDLSLHKED

SEQ ID NO: 47815 - protein, 824 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGDAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKVILCCIS

SEQ ID NO: 47816 - protein, 924 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNIFFFGCTVELGLHFKLTFSRNQSNL

SEQ ID NO: 47817 - protein, 908 aa, Homo sapiens
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 47818 - protein, 908 aa, Homo sapiens
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNSKSSVEFPMVKSGSTS

SEQ ID NO: 47819 - protein, 501 aa, Homo sapiens
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGCRRGIQMSLPWPTLFTPSFSSSWAVLALLSLLMKTEMLLDVMISSSIK

SEQ ID NO: 47820 - protein, 20 aa, Homo sapiens
MVCEGKRSASCPCFFLLTAK

SEQ ID NO: 47821 - protein, 908 aa, Homo sapiens; identical to SEQ ID NO: 47817

SEQ ID NO: 47822 - protein, 294 aa, Homo sapiens
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAA

SEQ ID NO: 47823 - protein, 373 aa, Homo sapiens
MTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFPGPQGPYYCGVGADRAYGRDIVEAHYRACLYAGVKIAGTNAEVMPAQWEFQIGPCEGISMGDHLWVARFILHRVCEDFGVIATFDPKPIPGNWNGAGCHTNFSTKAMREENGLKYIEEAIEKLSKRHQYHIRAYDPKGGLDNARRLTGFHETSNINDFSAGVANRSASIRIPRTVGQEKKGYFEDRRPSANCDPFSVTEALIRTCLLNETGDEPFQYKN

SEQ ID NO: 47824 - protein, 373 aa, Homo sapiens; identical to SEQ ID NO: 47823

SEQ ID NO: 47825 - protein, 373 aa, Homo sapiens; identical to SEQ ID NO: 47823

SEQ ID NO: 47826 - protein, 373 aa, Homo sapiens; identical to SEQ ID NO: 47823

SEQ ID NO: 47827 - protein, 233 aa, Homo sapiens
MTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFQGPRVHITVVWEQTEPMAGTSWRPITGPACMLESRLRGLMPRSCLPSGNFRLDLVKESAWEIISGWPVSSCIVCVKTLE

SEQ ID NO: 47828 - protein, 637 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 47829 - protein, 274 aa, Homo sapiens
MGTDSRAAKALLARARTLHLQTGNLLNWGRLRKKCPSTHSEELHDCIQKTLNEWSSQINPDLVREFPDVLECTVSHAVEKINPDEREEMKVSAKLFIVESNSSSSTRSAVDMACSVLGVAQLDSVIIASPPIEDGVNLSLEHLQPYWEELENLVQSKKIVAIGTSDLDKTQLEQLYQWAQVKPNSNQVNLASCCVMPPDLTAFAKQFDIQLLTHNDPKELLSEASFQEALQESIPDIQAHEWVPLWLLRYSVIVKSRGIIKSKGYILQAKRRGS

SEQ ID NO: 47830 - protein, 446 aa, Homo sapiens
MAARKGRRRTCETGEPMEAESGDTSSEGPAQVYLPGRGPPLREGEELVMDEEAYVLYHRAQTGAPCLSFDIVRDHLGDNRTELPLTLYLCAGTQAESAQSNRLMMLRMHNLHGTKPPPSEGSDEEEEEEDEEDEEERKPQLELAMVPHYGGINRVRVSWLGEEPVAGVWSEKGQVEVFALRRLLQVVEEPQALAAFLRDEQAQMKPIFSFAGHMGEGFALDWSPRVTGRLLTGDCQKNIHLWTPTDGGSWHVDQRPFVGHTRSVEDLQWSPTENTVFASCSADASIRIWDIRAAPSKACMLTTATAHDGDVNVISWSRREPFLLSGGDDGALKIWDLRQFKSGSPVATFKQHVAPVTSVEWHPQDSGVFAASGADHQITQWDLAVERDPEAGDVEADPGLADLPQQLLFVHQGETELKELHWHPQCPGLLVSTALSGFTIFRTISV

SEQ ID NO: 47831 - protein, 523 aa, Homo sapiens
MQRAAALVRRGCGPRTPSSWGRSQSSAAAEASAVLKVRPERSRRERILTLESMNPQVKAVEYAVRGPIVLKAGEIELELQRGIKKPFTEVIRANIGDAQAMGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 47832 - protein, 423 aa, Homo sapiens
MGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 47833 - protein, 413 aa, Homo sapiens
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 47834 - protein, 366 aa, Homo sapiens
MAPPSVFAEVPQAQPVLVFKLTADFREDPDPRKVNLGVGAYRTDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 47835 - protein, 392 aa, Homo sapiens
MQVWSPWKGAMCPRPHKPAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 47836 - protein, 430 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 47837 - protein, 189 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKDFLSSAEMSFCPNQPGETTHPSSGMLACSYKVIGIMTPRLAVLTSQALWRIFQKYQSRVFFFCMPAPTIPREWTRVRNSGRK

SEQ ID NO: 47838 - protein, 387 aa, Homo sapiens
MALLHSGRVLPGIAAAFHPGLAAAASARASSWWTHVEMGPPDPILGVTEAFKRDTNSKKMNLGVGAYRDDNGKPYVLPSVRKFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 47839 - protein, 496 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVYQDNVYAAGSQFHSFKKVLMEMGPPYAGQQELASFHSTSKGYMGECGFRGGYVEVVNMDAAVQQQMLKLMSVRLCPPVPGQALLDLVVSPPAPTDPSFAQFQAEKQAVLAELAAKAKLTEQVFNEAPGISCNPVQGAMYSFPRVQLPPRAVERAQELGLAPDMFFCLRLLEETGICVVPGSGFGQREGTYHFRMTILPPLEKLRLLLEKLSRFHAKFTLEYS

SEQ ID NO: 47840 - protein, 496 aa, Homo sapiens; identical to SEQ ID NO: 47839

SEQ ID NO: 47841 - protein, 669 aa, Homo sapiens
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 47842 - protein, 598 aa, Homo sapiens
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRHSFGPLDYESLQQELALKETVWKKVSPESNEDISTTVVYRMESLGEKS

SEQ ID NO: 47843 - protein, 174 aa, Homo sapiens
MGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 47844 - protein, 602 aa, Homo sapiens
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKCVSSNIVLLTQAFRKKFVIPDFEEFTGHVDRIFEDVKELTGGKVAAYIPQLAKSNPDLWGVSLCTVDGQRHSVGHTKIPFCLQSCVKPLTYAISISTLGTDYVHKFVGKEPSGLRYNKLSLNEEGIPHNPMVNAGAIVVSSLIKMDCNKAEKFDFVLQYLNKMAGNEYMGFSNATFQSEKETGDRNYAIGYYLKEKKCFPKGVDMMAALDLYFQLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQKLVSLFNFHNYDNLRHCARKLDPRREGAEIRNKTVVNLLFAAYSGDVSALRRFALSAMDMEQKDYDSRTALHVAAAEGHIEVVKFLIEACKVNPFAKDRWGNIPLDDAVQFNHLEVVKLLQDYQDSYTLSETQAEAAAEALSKENLESMV

SEQ ID NO: 47845 - protein, 177 aa, Homo sapiens
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKWQPTSLSWPSQTQTCGVSPCALWMVNGTLWATQRSPSACSPV

SEQ ID NO: 47846 - protein, 682 aa, Homo sapiens
MCGIFAYMNYRVPRTRKEIFETLIKGLQRLEYRGYDSAGVAIDGNNHEVKERHIQLVKKRGKVKALDEELYKQDSMDLKVEFETHFGIAHTRWATHGVPSAVNSHPQRSDKGNEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMELQQIMKGNFSAFMQKEIFEQPESVFNTMRGRVNFETNTVLLGGLKDHLKEIRRCRRLIVIGCGTSYHAAVATRQVLEELTELPVMVELASDFLDRNTPVFRDDVCFFISQSGETADTLLALRYCKDRGALTVGVTNTVGSSISRETDCGVHINAGPEIGVASTKAYTSQFISLVMFGLMMSEDRISLQNRRQEIIRGLRSLPELIKEVLSLEEKIHDLALELYTQRSLLVMGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 47847 - protein, 361 aa, Homo sapiens
MAGGRHRRVVGTLHLLLLVAALPWASRGVSPSASAWPEEKNYHQPAILNSSALRQIAEGTSISEMWQNDLQPLLIERYPGSPGSYAARQHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 47848 - protein, 312 aa, Homo sapiens
MAGGRHRRVVGTLHLLLLVAALPWASRGVSPSASAWPEEKHIMQRIQRLQADWVLEIDTFLSQTPYGYRSFSNIISTLNPTAKRHLVLACHYDSKYFSHWNNRVFVGATDSAVPCAMMLELARALDKKLLSLKTVSDSKPDLSLQLIFFDGEEAFLHWSPQDSLYGSRHLAAKMASTPHPPGARGTSQLHGMDLLVLLDLIGAPNPTFPNFFPNSARWFERLQAIEHELHELGLLKDHSLEGRYFQNYSYGGVIQDDHIPFLRRGVPVLHLIPSPFPEVWHTMDDNEENLDESTIDNLNKILQVFVLEYLHL

SEQ ID NO: 47849 - protein, 775 aa, Homo sapiens
MAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGKLVFNRTVTLKEDPGKV

SEQ ID NO: 47850 - protein, 764 aa, Homo sapiens
MAALDSLSLFTSLGLSEQKARETLKNSALSAQLREAATQAQQTLGSTIDKATGILLYGLASRLRDTRRLSFLVSYIATALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGKLVFNRTVTLKEDPGKV

SEQ ID NO: 47851 - protein, 282 aa, Homo sapiens
MPTCRLGPKFLLVSGVSAMAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGTYPVPARTQWNPAYWTCQSHQFQLWLCQV

SEQ ID NO: 47852 - protein, 957 aa, Homo sapiens
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGQVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 47853 - protein, 1512 aa, Homo sapiens
MATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIDSKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPIRLEVGPRDMKSCQFVAVRRDTGEKLTVAENEAETKLQAILEDIQVTLFTRASEDLKTHMVVANTMEDFQKILDSGKIVQIPFCGEIDCEDWIKKTTARDQDLEPGAPSMGAKSLCIPFKPLCELQPGAKCVCGKNPAKYYTLFGRSY

SEQ ID NO: 47854 - protein, 987 aa, Homo sapiens
MATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVIKSVVMTLCQKSIKVTGLPNTFMVILEDVAMLHIKPDQFTYTSDHFETIMKYAEKLIQEGKAYVDDTPAEQMKAEREQRIDSKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDK

SEQ ID NO: 47855 - protein, 975 aa, Homo sapiens
MATLSLTVNSGDPPLGALLAVEHVKDDVSISVEEGKENILHVSENVIFTDVNSILRYLARVATTAGLYGSNLMEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIDSKHRKNPIEKNLQMWEEMKKGSQFGQSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKLRALCKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKLNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEK

SEQ ID NO: 47856 - protein, 523 aa, Homo sapiens
MAALLRRLLQRERPSAASGRPVGRREANLGTDAGVAVRVRFAPSPTGFLHLGGLRTALYNYIFAKKYQGSFILRLEDTDQTRVVPGAAENIEDMLEWAGIPPDESPRRGGPAGPYQQSQRLELYAQATEALLKTGAAYPCFCSPQRLELLKKEALRNHQTPRYDNRCRNMSQEQVAQKLAKDPKPAIRFRLEQVVPAFQDLVYGWNRHEVASVEGDPVIMKSDGFPTYHLACVVDDHHMGISHVLRGSEWLVSTAKHLLLYQALGWQPPHFAHLPLLLNRDGSKLSKRQGDVFLEHFAADGFLPDSLLDIITNCGSGFAENQMGRTLPELITQFNLTQVTCHSALLDLEKLPEFNRLHLQRLVSNESQRRQLVGKLQVLVEEAFGCQLQNRDVLNPVYVERILLLRQGHICRLQDLVSPVYSYLWTRPAVGRAQLDAISEKVDVIAKRVLGLLERSSMSLTQDMLNGELKKLSEGLEGTKYSNVMKLLRMALSGQQQGPPVAEMMLALGPKEVRERIQKVVSS

SEQ ID NO: 47857 - protein, 523 aa, Homo sapiens; identical to SEQ ID NO: 47856

SEQ ID NO: 47858 - protein, 106 aa, Homo sapiens
MAQEFVNCKIQPGKVVVFIKPTCPYCRRAQEILSQLPIKQGLLEFVDITATNHTNEIQDYLQQLTGARTVPRVFIGKDCIGGCSDLVSLQQSGELLTRLKQIGALQ

SEQ ID NO: 47859 - protein, 106 aa, Homo sapiens; identical to SEQ ID NO: 47858

SEQ ID NO: 47860 - protein, 106 aa, Homo sapiens; identical to SEQ ID NO: 47858

SEQ ID NO: 47861 - protein, 106 aa, Homo sapiens; identical to SEQ ID NO: 47858

SEQ ID NO: 47862 - protein, 106 aa, Homo sapiens; identical to SEQ ID NO: 47858

SEQ ID NO: 47863 - protein, 164 aa, Homo sapiens
MIWRRAALAGTRLVWSRSGSAGWLDRAAGAAGAAAAAASGMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 47864 - protein, 165 aa, Homo sapiens
MNPRDKQVSRFSPLKDVYTWVALAGIQRSGSPGRTRSAARRMESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 47865 - protein, 335 aa, Homo sapiens
MAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 47866 - protein, 335 aa, Homo sapiens; identical to SEQ ID NO: 47865

SEQ ID NO: 47867 - protein, 335 aa, Homo sapiens; identical to SEQ ID NO: 47865

SEQ ID NO: 47868 - protein, 157 aa, Homo sapiens
MSGSLGRAAAALLRWGRGAGGGGLWGPGVRAAGSGAGGGGSAEQLDALVKKDKVVVFLKGTPEQPQCGFSNAVVQILRLHGVRDYAAYNVLDDPELRQGIKDYSNWPTIPQVYLNGEFVGGCDILLQMHQNGDLVEELKKLGIHSALLDEKKDQDSK

SEQ ID NO: 47869 - protein, 290 aa, Homo sapiens
MLKREMKPESDRPRKVRFRIASSHSGRVLKEVYEDGQPSGSLDSECASICGIDGLGDSDGQQNGHIESEGDENENDQDSLLVLARAASEKGFGTRRVNILSKNGTVRGVKYKVSAGQALFNNLTKVLQQPSTDLEFDRVVIYTTCLRVVRTTFERCELVRKIFQNHRVKFEEKNIALNGEYGKELDERCRRVSEAPSLPVVFIDGHYLGGAEKILSMNESGELQDILTKIERVQHPHECPSCGGFGFLPCSVCHGSKMSMFRNCFTDSFKALKCTACNENGLQRCKNCAG

SEQ ID NO: 47870 - protein, 438 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 47871 - protein, 328 aa, Homo sapiens
MALRGVSVRLLSRGPGLHVLRTWVSSAAQTASRPEFDWQDPLVLEEQLTTDEILIRDTFRTYCQERLMPRILLANRNEGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDK

SEQ ID NO: 47872 - protein, 394 aa, Homo sapiens
MRSSSGTPSAPTARRDSCLASCWPIATKSLALLPRLECSGTILAHCKFCLPGSSDSPASTPLVAGITGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 47873 - protein, 428 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEVVQMCSLKRRWNSL

SEQ ID NO: 47874 - protein, 98 aa, Homo sapiens
  MOD_RES (49)..(49): Selenocysteine
MCAARLAAAAAAAQSVYAFSARPLAGGEPVSLGSLRGKVLLIENVASLCGTTVRDYTQMNELQRRLGPRGLVVLGFPCNQFGHQVRRAERGGAGADVQ

SEQ ID NO: 47875 - protein, 203 aa, Homo sapiens
  MOD_RES (49)..(49): Selenocysteine
MCAARLAAAAAAAQSVYAFSARPLAGGEPVSLGSLRGKVLLIENVASLCGTTVRDYTQMNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 47876 - protein, 190 aa, Homo sapiens
  MOD_RES (40)..(40): Selenocysteine
MAFIAKSFYDLSAISLDGEKVDFNTFRGRAVLIENVASLCGTTTRDFTQLNELQCRFPRRLVVLGFPCNQFGHQENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 47877 - protein, 197 aa, Homo sapiens
  MOD_RES (73)..(73): Selenocysteine
MSLGRLCRLLKPALLCGALAAPGLAGTMCASRDDWRCARSMHEFSAKDIDGHMVNLDKYRGFVCIVTNVASQCGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 47878 - protein, 221 aa, Homo sapiens
MTTQLRVVHLLPLLLACFVQTSPKQEKMKMDCHKDEKGTIYDYEAIALNKNEYVSFKQYVGKHILFVNVATYCGLTAQYPELNALQEELKPYGLVVLGFPCNQFGKQEPGDNKEILPGLKYVRPGGGFVPSFQLFEKGDVNGEKEQKVFSFLKHSCPHPSEILGTFKSISWDPVKVHDIRWNFEKFLVGPDGIPVMRWSHRATVSSVKTDILAYLKQFKTK

SEQ ID NO: 47879 - protein, 100 aa, Homo sapiens
MTTQLRVVHLLPLLLACFVQTSPKQEKMKMDCHKDEKGTIYDYEAIALNKNEYVSFKQYVGKHILFVNVATYCGLTAQYPGMSVQGEDLYLVSSFLRKGM

SEQ ID NO: 47880 - protein, 522 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 47881 - protein, 479 aa, Homo sapiens
MACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 47882 - protein, 440 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 47883 - protein, 469 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 47884 - protein, 493 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 47885 - protein, 222 aa, Homo sapiens
MAEKPKLHYFNARGRMESTRWLLAAAGVEFEEKFIKSAEDLDKLRNDGYLMFQQVPMVEIDGMKLVQTRAILNYIASKYNLYGKDIKERALIDMYIEGIADLGEMILLLPVCPPEEKDAKLALIKEKIKNRYFPAFEKVLKSHGQDYLVGNKLSRADIHLVELLYYVEELDSSLISSFPLLKALKTRISNLPTVKKFLQPGSPRKPPMDEKSLEEARKIFRF

SEQ ID NO: 47886 - protein, 222 aa, Homo sapiens
MAEKPKLHYSNIRGRMESIRWLLAAAGVEFEEKFIKSAEDLDKLRNDGYLMFQQVPMVEIDGMKLVQTRAILNYIASKYNLYGKDIKEKALIDMYIEGIADLGEMILLLPFSQPEEQDAKLALIQEKTKNRYFPAFEKVLKSHGQDYLVGNKLSRADIHLVELLYYVEELDSSLISSFPLLKALKTRISNLPTVKKFLQPGSPRKPPMDEKSLEESRKIFRF

SEQ ID NO: 47887 - protein, 222 aa, Homo sapiens
MAGKPKLHYFNGRGRMEPIRWLLAAAGVEFEEKFIGSAEDLGKLRNDGSLMFQQVPMVEIDGMKLVQTRAILNYIASKYNLYGKDIKERALIDMYTEGMADLNEMILLLPLCRPEEKDAKIALIKEKTKSRYFPAFEKVLQSHGQDYLVGNKLSRADISLVELLYYVEELDSSLISNFPLLKALKTRISNLPTVKKFLQPGSPRKPPADAKALEEARKIFRF

SEQ ID NO: 47888 - protein, 172 aa, Homo sapiens
MFQQVPMVEIDGMKLVQTRAILNYIASKYNLYGKDIKERALIDMYTEGMADLNEMILLLPLCRPEEKDAKIALIKEKTKSRYFPAFEKVLQSHGQDYLVGNKLSRADISLVELLYYVEELDSSLISNFPLLKALKTRISNLPTVKKFLQPGSPRKPPADAKALEEARKIFRF

SEQ ID NO: 47889 - protein, 108 aa, Homo sapiens
MFQQVPMVEIDGMKLVQTRAILNYIASKYNLYGKDIKERALIDMYTEGMADLNEMILLLPLCRPEEKDAKIALIKEKTKSRYFPAFEADISLVELLYYVEELDSSLIS

SEQ ID NO: 47890 - protein, 222 aa, Homo sapiens
MAARPKLHYPNGRGRMESVRWVLAAAGVEFDEEFLETKEQLYKLQDGNHLLFQQVPMVEIDGMKLVQTRSILHYIADKHNLFGKNLKERTLIDMYVEGTLDLLELLIMHPFLKPDDQQKEVVNMAQKAIIRYFPVFEKILRGHGQSFLVGNQLSLADVILLQTILALEEKIPNILSAFPFLQEYTVKLSNIPTIKRFLEPGSKKKPPPDEIYVRTVYNIFRP

SEQ ID NO: 47891 - protein, 129 aa, Homo sapiens
MYVEGTLDLLELLIMHPFLKPDDQQKEVVNMAQKAIIRYFPVFEKILRGHGQSFLVGNQLSLADVILLQTILALEEKIPNILSAFPFLQEYTVKLSNIPTIKRFLEPGSKKKPPPDEIYVRTVYNIFRP

SEQ ID NO: 47892 - protein, 222 aa, Homo sapiens; identical to SEQ ID NO: 47890

SEQ ID NO: 47893 - protein, 89 aa, Homo sapiens
MYVEGTLDLLELLIMHPFLKPDDQQKEVVNMAQKAIIRYFPVFEKILRGHGQSFLVGNQLSLADVILLQTILALEEKIPNILSAFPFLQ

SEQ ID NO: 47894 - protein, 129 aa, Homo sapiens; identical to SEQ ID NO: 47891

SEQ ID NO: 47895 - protein, 222 aa, Homo sapiens
MAEKPKLHYSNARGSMESIRWLLAAAGVELEEKFLESAEDLDKLRNDGSLLFQQVPMVEIDGMKLVQTRAILNYIASKYNLYGKDMKERALIDMYTEGIVDLTEMILLLLICQPEERDAKTALVKEKIKNRYFPAFEKVLKSHRQDYLVGNKLSWADIHLVELFYYVEELDSSLISSFPLLKALKTRISNLPTVKKFLQPGSQRKPPMDEKSLEEARKIFRF

SEQ ID NO: 47896 - protein, 222 aa, Homo sapiens; identical to SEQ ID NO: 47895

SEQ ID NO: 47897 - protein, 218 aa, Homo sapiens
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 47898 - protein, 181 aa, Homo sapiens
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKGLEKISAYMKSSRFLPRPVFSKMAVWGNK

SEQ ID NO: 47899 - protein, 149 aa, Homo sapiens
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFGLEKISAYMKSSRFLPRPVFSKMAVWGNK

SEQ ID NO: 47900 - protein, 237 aa, Homo sapiens
MPMILGYWDIRGLAHAIRLLLEYTDSSYEEKKYTMGDAPDYDRSQWLNEKFKLGLDFPNGMLGSLVAQLSFAGFPSIQLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 47901 - protein, 218 aa, Homo sapiens
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKITFVDFIAYDVLERNQVFEPSCLDAFPNLKDFISRFEGLEKISAYMKSSRFLPRPVFTKMAVWGNK

SEQ ID NO: 47902 - protein, 179 aa, Homo sapiens
MTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKGLEKISAYMKSSRFLPRPVFTKMAVWGNK

SEQ ID NO: 47903 - protein, 87 aa, Homo sapiens
MDSRMQLAKLCYDPDFEKLKPEYLQALPEMLKLYSQFLGKQPWFLGDKITFVDFIAYDVLERNQVFEPSCLDAFPNLKDFISRFEHS

SEQ ID NO: 47904 - protein, 191 aa, Homo sapiens
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFEKLKPEYLQALPEMLKLYSQFLGKQPWFLGDKITFVDFIAYDVLERNQVFEPSCLDAFPNLKDFISRFEHS

SEQ ID NO: 47905 - protein, 191 aa, Homo sapiens; identical to SEQ ID NO: 47904

SEQ ID NO: 47906 - protein, 225 aa, Homo sapiens
MSCESSMVLGYWDIRGLAHAIRLLLEFTDTSYEEKRYTCGEAPDYDRSQWLDVKFKLDLDFPNLPYLLDGKNKITQSNAILRYIARKHNMCGETEEEKIRVDIIENQVMDFRTQLIRLCYSSDHEKLKPQYLEELPGQLKQFSMFLGKFSWFAGEKLTFVDFLTYDILDQNRIFDPKCLDEFPNLKAFMCRFEALEKIAAYLQSDQFCKMPINNKMAQWGNKPVC

SEQ ID NO: 47907 - protein, 225 aa, Homo sapiens; identical to SEQ ID NO: 47906

SEQ ID NO: 47908 - protein, 225 aa, Homo sapiens; identical to SEQ ID NO: 47906

SEQ ID NO: 47909 - protein, 195 aa, Homo sapiens
MSMTLGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQAMDVSNQLARVCYSPDFEKLKPEYLEELPTMMQHFSQFLGKRPWFVGDKITFVDFLAYDVLDLHRIFEPNCLDAFPNLKDFISRFEVSCGIM

SEQ ID NO: 47910 - protein, 157 aa, Homo sapiens
MSMTLGYWDIRGLAHAIRLLLEYTDSSYEEKKYTMGDAPDYDRSQWLNEKFKLGLDFPNEKLKPEYLEELPTMMQHFSQFLGKRPWFVGDKITFVDFLAYDVLDLHRIFEPNCLDAFPNLKDFISRFEGLEKISAYMKSSRFLPKPLYTRVAVWGNK

SEQ ID NO: 47911 - protein, 202 aa, Homo sapiens
MLGSLLAQLSFPGFPSIQLPYLIDGAHKITQSNAILCYIARKHNLCGETEEEKIRVDILENQAMDVSNQLARVCYSPDFEKLKPEYLEELPTMMQHFSQFLGKRPWFVGDKITFVDFLAYDVLDLHRIFEPNCLDAFPNLKDFISRFEVMPPSSFLFDAPCSVTSFQMLSQSWSYIKNNLHLLSAGFMPGTLPSTLYLSCGI

SEQ ID NO: 47912 - protein, 218 aa, Homo sapiens
MSMTLGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQAMDVSNQLARVCYSPDFEKLKPEYLEELPTMMQHFSQFLGKRPWFVGDKITFVDFLAYDVLDLHRIFEPNCLDAFPNLKDFISRFEGLEKISAYMKSSRFLPKPLYTRVAVWGNK

SEQ ID NO: 47913 - protein, 218 aa, Homo sapiens
MPMTLGYWDIRGLAHAIRLLLEYTDSSYVEKKYTLGDAPDYDRSQWLNEKFKLGLDFPNLPYLIDGAHKITQSNAILRYIARKHNLCGETEEEKIRVDILENQVMDNHMELVRLCYDPDFEKLKPKYLEELPEKLKLYSEFLGKRPWFAGDKITFVDFLAYDVLDMKRIFEPKCLDAFLNLKDFISRFEGLKKISAYMKSSQFLRGLLFGKSATWNSK

SEQ ID NO: 47914 - protein, 237 aa, Homo sapiens
MPMTLGYWDIRGLAHAIRLLLEYTDSSYVEKKYTLGDAPDYDRSQWLNEKFKLGLDFPNGMLGSLVAQLSFPGFPSIQLPYLIDGAHKITQSNAILRYIARKHNLCGETEEEKIRVDILENQVMDNHMELVRLCYDPDFEKLKPKYLEELPEKLKLYSEFLGKRPWFAGDKITFVDFLAYDVLDMKRIFEPKCLDAFLNLKDFISRFEGLKKISAYMKSSQFLRGLLFGKSATWNSK

SEQ ID NO: 47915 - protein, 202 aa, Homo sapiens
MLGSLVAQLSFPGFPSIQLPYLIDGAHKITQSNAILRYIARKHNLCGETEEEKIRVDILENQVMDNHMELVRLCYDPDFEKLKPKYLEELPEKLKLYSEFLGKRPWFAGDKITFVDFLAYDVLDMKRIFEPKCLDAFLNLKDFISRFEVMPPSSFLFDAPCSFLSFQMLSQSWSYTKNNSYVLSTGFMPGIMPSTLYLSCRI

SEQ ID NO: 47916 - protein, 208 aa, Homo sapiens
MSGESARSLGKGSAPPGPVPEGSIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 47917 - protein, 241 aa, Homo sapiens
MSGESARSLGKGSAPPGPVPEGSIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 47918 - protein, 180 aa, Homo sapiens
MRFCPFAERTRLVLKAKGIRHEVININLKNKPEWFFKKNPFGLVPVLENSQGQLIYESAITCEYLDEAYPGKKLLPDDPYEKACQKMILELFSKVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 47919 - protein, 200 aa, Homo sapiens
MRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLEL

SEQ ID NO: 47920 - protein, 213 aa, Homo sapiens
MRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSQNKEDYAGLKEEFRKEFTKLEEVLTNKKTTFFGGNSISMIDYLIWPWFERLEAMKLNECVDHTPKLKLWMAAMKEDPTVSALLTSEKDWQGFLELYLQNSPEACDYGL

SEQ ID NO: 47921 - protein, 243 aa, Homo sapiens
MSGDATRTLGKGSQPPGPVPEGLIRIYSMRFCPYSHRTRLVLKAKDIRHEVVNINLRNKPEWYYTKHPFGHIPVLETSQCQLIYESVIACEYLDDAYPGRKLFPYDPYERARQKMLLELFCKVPHLTKECLVALRCGRECTNLKAALRQEFSNLEEILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 47922 - protein, 215 aa, Homo sapiens
MRFCPYSHRTRLVLKAKDIRHEVVNINLRNKPEWYYTKHPFGHIPVLETSQCQLIYESVIACEYLDDAYPGRKLFPYDPYERARQKMLLELFCKVPHLTKECLVALRCGRECTNLKAALRQEFSNLEEILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 47923 - protein, 243 aa, Homo sapiens; identical to SEQ ID NO: 47921

SEQ ID NO: 47924 - protein, 166 aa, Homo sapiens
MSGDATRTLGKGSQPPGPVPEGLIRIYSMRFCPYSHRTRLVLKAKDIRHEVVNINLRNKPEWYYTKHPFGHIPVLETSQCQLIYESVIACEYLDDAYPGRKLFPYDPYERARQKMLLELFCKVPHLTKECLVALRCGRECTNLKAALRQEFSNLEEDRKKRKFIPG

SEQ ID NO: 47925 - protein, 121 aa, Homo sapiens
MRFCPYSHRTRLVLKAKDIRHEVVNINLRNKPEWYYTKHPFGHIPVLETSQCQLIYESVIACEYLDDAYPGRKLFPYDPYERARQKMLLELFCKLCEPHASPAALDISHEVGPHSLCSSHG

SEQ ID NO: 47926 - protein, 209 aa, Homo sapiens
MSGDATRTLGKGSQPPGPVPEGLIRIYSMRFCPYSHRTRLVLKAKDIRHEVVNINLRNKPEWYYTKHPFGHIPVLETSQCQLIYESVIACEYLDDAYPGRKLFPYDPYERARQKMLLELFCKILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 47927 - protein, 240 aa, Homo sapiens
MGLELYLDLLSQPCRAVYIFAKKNDIPFELRIVDLIKGQHLSDAFAQVNPLKKVPALKDGDFTLTESVAILLYLTRKYKVPDYWYPQDLQARARVDEYLAWQHTTLRRSCLRALWHKVMFPVFLGEPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 47928 - protein, 161 aa, Homo sapiens
MGLELYLDLLSQPCRAVYIFAKKNDIPFELRIVDLIKGVMFPVFLGEPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 47929 - protein, 122 aa, Homo sapiens
MFPVFLGEPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 47930 - protein, 65 aa, Homo sapiens
MGLELYLDLLSQPCRAVYIFAKKNDIPFELRIVDLIKGQHLSDAFAQVNPLKKVPALKDGDFTLT

SEQ ID NO: 47931 - protein, 72 aa, Homo sapiens
MGLELYLDLLSQPCRAVYIFAKKNDIPFELRIVDLIKARGCWLPSLRRPTQAGHMAAARGGSSGGGPLPGGP

SEQ ID NO: 47932 - protein, 244 aa, Homo sapiens
MGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQVLGPLIGVQVPKEKVERNRTAMDQALQWLEDKFLGDRPFLAGQQVTLADLMALEELMQPVALGYELFEGRPRLAAWRGRVEAFLGAELCQEAHSIILSILEQAAKKTLPTPSPEAYQAMLLRIARIP

SEQ ID NO: 47933 - protein, 474 aa, Homo sapiens
MATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQVLKEGIAQTVFLGLNRSDYMFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 47934 - protein, 363 aa, Homo sapiens
MATNWGSLLQDKQQLEELARQAVDRALAEGVLLRTSQEPTSSEVVSYAPFTLFPSLVPSALLEQAYAVQMDFNLLVDAVSQNAAFLEQTLSSALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 47935 - protein, 346 aa, Homo sapiens
MFQRSADGSPALKQIEINTISASFGGLASRTPAVHRHVLSVLSKTKEAGKILSNNPSKGLALGIAKAWELYGSPNALVLLIAQEKERNIFDQRAIENELLARNIHVIRRTFEDISEKGSLDQDRRLFVDGQEIAVVYFRDGYMPRQYSLQNWEARLLLERSHAAKCPDIATQLAGTKKVQQELSRPGMLEMLLPGQPEAVARLRATFAGLYSLDVGEEGDQAIAEALAAPSRFVLKPQREGGGNNLYGEEMVQALKQLKDSEERASYILMEKIEPEPFENCLLRPGSPARVVQCISELGIFGVYVRQEKTLVMNKHVGHLLRTKAIEHADGGVAAGVAVLDNPYPV

SEQ ID NO: 47936 - protein, 216 aa, Homo sapiens
MQAGKPILYSYFRSSCSWRVRIALALKGIDYETVPINLIKDGGQQFSKDFQALNPMKQVPTLKIDGITIHQSLAIIEYLEEMRPTPRLLPQDPKKRASVRMISDLIAGGIQPLQNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 47937 - protein, 174 aa, Homo sapiens
MQAGKPILYSYFRSSCSWRVRIALALKGIDYETVPINLIKDGGQQFSKDFQALNPMKQVPTLKIDGITIHQSNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 47938 - protein, 161 aa, Homo sapiens
MKQVPTLKIDGITIHQSLAIIEYLEEMRPTPRLLPQDPKKRASVRMISDLIAGGIQPLQNLSVLKQVGEEMQLTWAQNAITCGFNALEQILQSTAGIYCVGDEVTMADLCLVPQVANAERFKVDLTPYPTISSINKRLLVLEAFQVSHPCRQPDTPTELRA

SEQ ID NO: 47939 - protein, 161 aa, Homo sapiens; identical to SEQ ID NO: 47938

SEQ ID NO: 47940 - protein, 59 aa, Homo sapiens
MKQVPTLKIDGITIHQSLAIIEYLEEMRPTPRLLPQDPKKRASVRMISDLIAGGIQPLQ

SEQ ID NO: 47941 - protein, 38 aa, Homo sapiens
MKQVPTLKIDGITIHQSLAIIEYLEEMRPTPRLLPQDP

SEQ ID NO: 47942 - protein, 161 aa, Homo sapiens; identical to SEQ ID NO: 47938

SEQ ID NO: 47943 - protein, 335 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 47944 - protein, 260 aa, Homo sapiens
MEEMRDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 47945 - protein, 293 aa, Homo sapiens
MVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 47946 - protein, 335 aa, Homo sapiens; identical to SEQ ID NO: 47943

SEQ ID NO: 47947 - protein, 335 aa, Homo sapiens; identical to SEQ ID NO: 47943

SEQ ID NO: 47948 - protein, 215 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQREAHWHGLPCPHCQRVSGGPDLPSRKTCQI

SEQ ID NO: 47949 - protein, 408 aa, Homo sapiens
MSKRDIVLTNVTVVQLLRQPCPVTRAPPPPEPKAEVEPQPQPEPTPVREEIKPPPPPLPPHPATPPPKMVSVARELTVGINGFGRIGRLVLRACMEKGVKVVAVNDPFIDPEYMVYMFKYDSTHGRYKGSVEFRNGQLVVDNHEISVYQCKEPKQIPWRAVGSPYVVESTGVYLSIQAASDHISAGAQRVVISAPSPDAPMFVMGVNENDYNPGSMNIVSNASCTTNCLAPLAKVIHERFGIVEGLMTTVHSYTATQKTVDGPSRKAWRDGRGAHQNIIPASTGAAKAVTKVIPELKGKLTGMAFRVPTPDVSVVDLTCRLAQPAPYSAIKEAVKAAAKGPMAGILAYTEDEVVSTDFLGDTHSSIFDAKAGIALNDNFVKLISWYDNEYGYSHRVVDLLRYMFSRDK

SEQ ID NO: 47950 - protein, 367 aa, Homo sapiens
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGWGTPAAHRDDRYQCHGHPPLVPAASVMA

SEQ ID NO: 47951 - protein, 234 aa, Homo sapiens
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISGGEPHPVRCGGGPCGGDCQWPHRGQFPQCARLPAYPQSLRPPCSPATFCEDCAVSGRL

SEQ ID NO: 47952 - protein, 457 aa, Homo sapiens
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGDVKSMAQFYGLLAHVARTRLTPSMAGASVEEDAQLHELAAELQIPDLQLEEALETMAWGRGPVCLLAGGEPTVQLQGSGRGGRNQELALRVGAELRRWPLGPIDVLFLSGGTDGQDGPTEAAGAWVTPELASQAAAEGLDIATFLAHNDSHTFFCCLQGGAHLLHTGMTGTNVMDTHLLFLRPR

SEQ ID NO: 47953 - protein, 523 aa, Homo sapiens
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGDVKSMAQFYGLLAHVARTRLTPSMAGASVEEDAQLHELAAELQIPDLQLEEALETMAWGRGPVCLLAGGEPTVQLQGSGRGGRNQELALRVGAELRRWPLGPIDVLFLSGGTDGQDGPTEAAGAWVTPELASQAAAEGLDIATFLAHNDSHTFFCCLQGGAHLLHTGMTGTNVMDTHLLFLRPR

SEQ ID NO: 47954 - protein, 283 aa, Homo sapiens
MELLLSQSCIWWPMVGEGRTIISCGIKAMERSGNYLIWLQKGEMLLKPHSRVQVFEGAEDNLPDRDALRAALAIQQLAEGLTADDLLLVLISGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGWGTPAAHRDDRYQCHGHPPLVPAASVMA

SEQ ID NO: 47955 - protein, 240 aa, Homo sapiens
MLLKPHSRVQVFEGAEDNLPDRDALRAALAIQQLAEGLTADDLLLVLISGGGSALLPAPIPPVTLEEKQTLTRLLAARGATIQELNTIRKALSQLKGGGLAQAAYPAQVVSLILSDVVGDPVEVIASGPTVASSHNVQDCLHILNRYGLRAALPRSVKTVLSRADSDPHGPHTCGHVLNVIIGSNVLALAEAQRQAEALGYQAVVLSAAMQGWGTPAAHRDDRYQCHGHPPLVPAASVMA

SEQ ID NO: 47956 - protein, 205 aa, Homo sapiens
MAAALQVLPRLARAPLHPLLWRGSVARLASSMALAEQARQLFESAVGAVLPGPMLHRALSLDPGGRQLKVRDRNFQLRQNLYLVGFGKAVLGMAAAAEELLGQHLVQGVISVPKGIRAAMERAGKQEMLLKPHSRVQVFEGAEDNLPDRDALRAALAIQQLAEGLTADDLLLVLISGWGTPAAHRDDRYQCHGHPPLVPAASVMA

SEQ ID NO: 47957 - protein, 234 aa, Homo sapiens; identical to SEQ ID NO: 47951

SEQ ID NO: 47958 - protein, 94 aa, Homo sapiens
KILDAMNRDCGIPLSHLQVDGGMTSNKILMQLQADILYIPVVKPSMPETTALGAAMAAGAAEGVGVWSLEPEDLSAVTMERFEPQINAEGTFKE

SEQ ID NO: 47959 - protein, 553 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGDPSIFCSLPLGFFIVSSMVMLIGARYISGIP

SEQ ID NO: 47960 - protein, 524 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGIP

SEQ ID NO: 47961 - protein, 530 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKISHSVKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGIP

SEQ ID NO: 47962 - protein, 354 aa, Homo sapiens
MLFNIHSLEWDKQLCEFFGIPMEILPNVRSSSEIYGLMKISHSVKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGDPSIFCSLPLGFFIVSSMVMLIGARYISGIP

SEQ ID NO: 47963 - protein, 367 aa, Homo sapiens
MAYLDNFKTNARHFILFVNISSLTGGVNGGVHCTDVTNASRTMLFNIHSLEWDKQLCEFFGIPMEILPNVRSSSEIYGLMKISHSVKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGIP

SEQ ID NO: 47964 - protein, 559 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMTIHNSKKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGDPSIFCSLPLGFFIVSSMVMLIGARYISGIP

SEQ ID NO: 47965 - protein, 553 aa, Homo sapiens
MAAPKTAAVGPLVGAVVQGTNSTRFLVFNSKTAELLSHHKVELTQEFPKEGWVEQDPKEILQSVYECIARTCEKLDELNIDISNIKAVGVSNQRETTVIWDKLTGEPLYNAVVWLDLRTQTTVEDLSKKIPGNSNFVKSKTGLPLSTYFSAVKLRWMLDNVRNVQKAVEEGRALFGTIDSWLIWSLTGGVNGGVHCTDVTNASRTMLFNIHSLEWDKELCDFFEIPMDLLPNVFSSSEIYGLIKTGALEGVPISGCLGDQCAALVGQMCFQEGQAKNTYGTGCFLLCNTGRKCVFSEHGLLTTVAYKLGREKPAYYALEGSVAIAGAVIRWLRDNLGIIETSGDIERLAKEVGTSYGCYFVPAFSGLYAPYWEPSARGILCGLTQFTNKCHIAFAALEAVCFQTREILEAMNRDCGIPLRHLQVDGGMTNNKVLMQLQADILHIPVIKPFMPETTALGAAMAAGAAEGVSVWSLEPQALSVLRMERFEPQIQATESEIRYATWKKAVMKSMGWVTSQSPEGGDPSIFSSLPLGFFIVSSMVMLIGARYISGVP

SEQ ID NO: 47966 - protein, 349 aa, Homo sapiens
MASKKVCIVGSGNWGSAIAKIVGGNAAQLAQFDPRVTMWVFEEDIGGKKLTEIINTQHENVKYLPGHKLPPNVVAVPDVVQAAEDADILIFVVPHQFIGKICDQLKGHLKANATGISLIKGVDEGPNGLKLISEVIGERLGIPMSVLMGANIASEVADEKFCETTIGCKDPAQGQLLKELMQTPNFRITVVQEVDTVEICGALKNVVAVGAGFCDGLGFGDNTKAAVIRLGLMEMIAFAKLFCSGPVSSATFLESCGVADLITTCYGGRNRKVAEAFARTGKSIEQLEKELLNGQKLQGPETARELYSILQHKGLVDKFPLFMAVYKVCYEGQPVGEFIHCLQNHPEHM

SEQ ID NO: 47967 - protein, 326 aa, Homo sapiens
MQTPNFRITVVQEVDTVEICGALKVRGAQRQLWGEEKAPKEVWLSSARLQVLQALTIEQWFPFPTMSHAYRRSCRSKARAIQADYSSSDRGPPCSCPILAPCGTPHPLAPGGQGDKEMPRLMGDKTSLTPRQTNGQNYGSWTAVDGLYNGMVRWEDQLERRVVFRKCPRGGSMGQGLRKGVQQGGKPRGGSRLLKGHTLYLSSAVGVTADEMSMRGLHMGPIGGGLFTYDLHSFKNVVAVGAGFCDGLGFGDNTKAAVIRLGLMEMIAFAKLFCSGPVSSATFLESCGVADLITTCYGGRNRKVAEAFARTGKVGPGRRENRGAAL

SEQ ID NO: 47968 - protein, 351 aa, Homo sapiens
MAAAPLKVCIVGSGNWGSAVAKIIGNNVKKLQKFASTVKMWVFEETVNGRKLTDIINNDHENVKYLPGHKLPENVVAMSNLSEAVQDADLLVFVIPHQFIHRICDEITGRVPKKALGITLIKGIDEGPEGLKLISDIIREKMGIDISVLMGANIANEVAAEKFCETTIGSKVMENGLLFKELLQTPNFRITVVDDADTVELCGALKNIVAVGAGFCDGLRCGDNTKAAVIRLGLMEMIAFARIFCKGQVSTATFLESCGVADLITTCYGGRNRRVAEAFARTGKTIEELEKEMLNGQKLQGPQTSAEVYRILKQKGLLDKFPLFTAVYQICYESRPVQEMLSCLQSHPEHT

SEQ ID NO: 47969 - protein, 619 aa, Homo sapiens
MESSSSSNSYFSVGPTSPSAVVLLYSLSKESLQSVDVLREEVSEILDEMSHKLRLGAIRFCAFTLSKVFKQIFSKVCVNEEGIQKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQLLNIFVRPSLVAVALQMTPGFRKEDVYSCFRFLRDVFADEFIFLPGNTLKDFEEGCYLLCKSEAIQVTTKDILVTEKGNTVLEFLVGLFKPFVESYQIICKYLLSEEEDHFSEEQYLAAVRKFTSQLLDQGTSQCYDVLSSDVQKNALAACVRLGVVEKKKINNNCIFNVNEPATTKLEEMLGCKTPIGKPATAKL

SEQ ID NO: 47970 - protein, 680 aa, Homo sapiens
MESSSSSNSYFSVGPTSPSAVVLLYSKELKKWDEFEDILEERRHVSDLKFAMKCYTPLVYKGITPCKPIDIKCSVLNSEEIHYVIKQLSKESLQSVDVLREEVSEILDEMSHKLRLGAIRFCAFTLSKVFKQIFSKVCVNEEGIQKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQLLNIFVRPSLVAVALQMTPGFRKEDVYSCFRFLRDVFADEFIFLPGNTLKDFEEGCYLLCKSEAIQVTTKDILVTEKGNTVLEFLVGLFKPFVESYQIICKYLLSEEEDHFSEEQYLAAVRKFTSQLLDQGTSQCYDVLSSDVQKNALAACVRLGVVEKKKINNNCIFNVNEPATTKLEEMLGCKTPIGKPATAKL

SEQ ID NO: 47971 - protein, 587 aa, Homo sapiens
MESSSSSNSYFSVGPTSPSAVVLLYSKELKKWDEFEDILEERRHVSDLKFAMKCYTPLVYKGITPCKPIDIKCSVLNSEEIHYVIKQLSKESLQSVDVLREEVSEILDEMSHKLRLGAIRFCAFTLSKVFKQIFSKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISISYDKILEETLYVYELLGVPKPKESTTGLLKARKILSENFGSIHVYFGDPVSLRSLAAGRMSRSSYNLVPRYIPQKQSEDMHAFVTEVAYKMELLQIENMVLSPWTLIVAVLLQNRPSMDFDALVEKTLWLKGLTQAFGGFLIWPDNKPAEEVVPASILLHSNIASLVKDQVILKVDSGDSEVVDGLMLQHITLLMCSAYRNQLLNIFVRPSLVAVALQMTPGFRKEDVYSCFRFLRDVFADEFIFLPGNTLKDFEEGCYLLCKSEAIQVTTKDILVTEKGNTVLEFLVGLFKPFVESYQIICKYLLSEEEDHFSE

SEQ ID NO: 47972 - protein, 222 aa, Homo sapiens
MESSSSSNSYFSVGPTSPSAVVLLYSLSKESLQSVDVLREEVSEILDEMSHKLRLGAIRFCAFTLSKVFKQIFSKVCVNEEGIQKLQRAIQEHPVVLLPSHRSYIDFLMLSFLLYNYDLPVPVIAAGMDFLGMKMVGELLRMSGAFFMRRTFGGNKLYWAVFSEYVKTMLRNGYAPVEFFLEGTRSRSAKTLTPKFGLLNIVMEPFFKREVFDTYLVPISIS

SEQ ID NO: 47973 - protein, 289 aa, Homo sapiens
MSRNSRKTIGKVRVDYIIIKPLPGYSCDMKSSFSKYWKPRIPLDVGHRGAGNSTTTAQLAKVQENTIASLRNAASHGAAFVEFDVHLSKDFVPVVYHDLTCCLTMKKNLWFRRKIPFQKISHFLLLRWVRQKQNKYPILFLTQGKSEIYPELMDLRSRTTPIAMSFAQFENLLGINVHTEDLLRNPSYIQEAKAKGLVIFCWGDDTNDPENRRKLKELGVNGLIYDRIYDWMPEQPNIFQVEQLERLKQELPELKSCLCPTVSRFVPSSLCGESDIHVDANGIDNVENA

SEQ ID NO: 47974 - protein, 672 aa, Homo sapiens
MTPSQVAFEIRGTLLPGEVFAICGSCDALGNWNPQNAVALLPENDTGESMLWKATIVLSRGVSVQYRYFKGYFLEPKTIGGPCQVIVHKWETHLQPRSITPLESEIIIDDGQFGIHNGVETLDSGWLTCQTEIRLRLHYSEKPPVSITKKKLKKSRFRVKLTLEGLEEDDDDRVSPTVLHKMSNSLEISLISDNEFKCRHSQPECGYGLQPDRWTEYSIQTMEPDNLELIFDFFEEDLSEHVVQGDALPGHVGTACLLSSTIAESGKSAGILTLPIMSRNSRKTIGKVRVDYIIIKPLPGYSCDMKSSFSKYWKPRIPLDVGHRGAGNSTTTAQLAKVQENTIASLRNAASHGAAFVEFDVHLSKDFVPVVYHDLTCCLTMKKKFDADPVELFEIPVKELTFDQLQLLKLTHVTALKSKDRKESVVQEENSFSENQPFPSLKMVLESLPEDVGFNIEIKWICQQRDGMWDGNLSTYFDMNLFLDIILKTVLENSGKRRIVFSSFDADICTMVRQKQNKYPILFLTQGKSEIYPELMDLRSRTTPIAMSFAQFENLLGINVHTEDLLRNPSYIQEAKAKGLVIFCWGDDTNDPENRRKLKELGVNGLIYDRIYDWMPEQPNIFQVEQLERLKQELPELKSCLCPTVSRFVPSSLCGESDIHVDANGIDNVENA

SEQ ID NO: 47975 - protein, 264 aa, Homo sapiens
  MOD_RES (1)..(1): Any amino acid
XCDMKSSFSKYWKPRIPLDVGHRGAGNSTTTAQLAKVQENTIASLRNAASHGAAFVEFDVHLSKDFVPVVYHDLTCCLTMKKNLWFRRKIPFQKISHFLLLRWVRQKQNKYPILFLTQGKSEIYPELMDLRSRTTPIAMSFAQFENLLGINVHTEDLLRNPSYIQEAKAKGLVIFCWGDDTNDPENRRKLKELGVNGLIYDRIYDWMPEQPNIFQVEQLERLKQELPELKSCLCPTVSRFVPSSLCGESDIHVDANGIDNVENA

SEQ ID NO: 47976 - protein, 331 aa, Homo sapiens
MWLWEDQGGLLGPFSFLLLVLLLVTRSPVNACLLTGSLFVLLRVFSFEPVPSCRALQVLKPRDRISAIAHRGGSHDAPENTLAAIRQAAKNGATGVELDIEFTSDGIPVLMHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 47977 - protein, 605 aa, Homo sapiens
MVRHQPLQYYEPQLCLSCLTGIYGCRWKRYQRSHDDTTPWERLWFLLLTFTFGLTLTWLYFWWEVHNDYDEFNWYLYNRMGYWSDWPVPILVTTAAAFAYIAGLLVLALCHIAVGQQMNLHWLHKIGLVVILASTVVAMSAVAQLWEDEWEVLLISLQGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 47978 - protein, 486 aa, Homo sapiens
MVRHQPLQYYEPQLCLSCLTGIYGCRWKRYQRSHDDTTPGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 47979 - protein, 135 aa, Homo sapiens
MVRHQPLQYYEPQLCLSCLTGIYGCRWKRYQRSHDDTTPWERLWFLLLTFTFGLTLTWLYFWWEVHNDYDEFNWYLYNRMGYWSDWPVPILVTTAAAFAYIAGLLVLALCHIAVGQQMNLHWLHKASSGLPLSPL

SEQ ID NO: 47980 - protein, 467 aa, Homo sapiens
MSAVAQLWEDEWEVLLISLQGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 47981 - protein, 605 aa, Homo sapiens; identical to SEQ ID NO: 47977

SEQ ID NO: 47982 - protein, 73 aa, Homo sapiens
MVRHQPLQYYEPQLCLSCLTGIYGCRWKRYQRSHDDTTPWERLWFLLLTFTFGLTLTWLYFWWEVHNDYDEFN

SEQ ID NO: 47983 - protein, 486 aa, Homo sapiens; identical to SEQ ID NO: 47978

SEQ ID NO: 47984 - protein, 360 aa, Homo sapiens
MSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 47985 - protein, 423 aa, Homo sapiens
MLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGITTIKVNIRNANSLGGGFHCWTCDVRRRGTLQSYLD

SEQ ID NO: 47986 - protein, 391 aa, Homo sapiens
MLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGMYNK

SEQ ID NO: 47987 - protein, 419 aa, Homo sapiens
MWPGNAWRAALFWVPRGRRAQSALAQLRGILEGELEGIRGAGTWKSERVITSRQGPHIRVDGVSGGILNFCANNYLGLSSHPEVIQAGLQALEEFGAGLSSVRFICGTQSIHKNLEAKIARFHQREDAILYPSCYDANAGLFEALLTPEDAVLSDELNHASIIDGIRLCKAHKYRYRHLDMADLEAKLQEAQKHRLRLVATDGAFSMDGDIAPLQEICCLASRYGALVFMDECHATGFLGPTGRGTDELLGVMDQVTIINSTLGKALGGASGGYTTGPGPLVSLLRQRARPYLFSNSLPPAVVGCASKALDLLMGSNTIVQSMAAKTQRFRSKMEAAGFTISGASHPICPVMLGDARLASRMADDMLKRGIFVIGFSYPVVPKGKARIRVQISAVHSEEDIDRCVEAFVEVGRLHGALP

SEQ ID NO: 47988 - protein, 445 aa, Homo sapiens
MWPGNAWRAALFWVPRGRRAQSALAQLRGILEGELEGIRGAGTWKSERVITSRQGPHIRVDGVSGGPGTVIFPGLPLPHLSCCIHLLSFTSGILNFCANNYLGLSSHPEVIQAGLQALEEFGAGLSSVRFICGTQSIHKNLEAKIARFHQREDAILYPSCYDANAGLFEALLTPEDAVLSDELNHASIIDGIRLCKAHKYRYRHLDMADLEAKLQEAQKHRLRLVATDGAFSMDGDIAPLQEICCLASRYGALVFMDECHATGFLGPTGRGTDELLGVMDQVTIINSTLGKALGGASGGYTTGPGPLVSLLRQRARPYLFSNSLPPAVVGCASKALDLLMGSNTIVQSMAAKTQRFRSKMEAAGFTISGASHPICPVMLGDARLASRMADDMLKRGIFVIGFSYPVVPKGKARIRVQISAVHSEEDIDRCVEAFVEVGRLHGALP

SEQ ID NO: 47989 - protein, 247 aa, Homo sapiens
MWPGNAWRAALFWVPRGRRAQSALAQLRGILEGELEGIRGAGTWKSERVITSRQGPHIRVDGVSGGPGTVIFPGLPLPHLSCCIHLLSFTSGILNFCANNYLGLSSHPEVIQAGLQALEEFGAGLSSVRFICGTQSIHKNLEAKIARFHQREDAILYPSCYDANAGLFEALLTPEDAVLSDELNHASIIDGIRLCKAHKYRYRHLDMADLEAKLQEAQKHRLRLVATDGAFHGWRHRTPAGDLLPRL

SEQ ID NO: 47990 - protein, 173 aa, Homo sapiens
MALRVVRSVRALLCTLRAVPSPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 47991 - protein, 1020 aa, Homo sapiens
MQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 47992 - protein, 295 aa, Homo sapiens
MVDSVYRTRSLGVAAEGLPDQYADGEAARVWQLYIGDTRSRTAEYKAWLLGLLRQHGCQRVLDVACGTGVDSIMLVEEGFSVTSVDASDKMLKYALKERWNRRHEPAFDKWVIEEANWMTLDKDVPQSAEGGFDAVICLGNSFAHLPDCKGDQSEHRLALKNIASMVRAGGLLVIDHRNYDHILSTGCAPPGKNIYYKSDLTKDVTTSVLIVNNKAHMVTLDYTVQVPGAGQDGSPGLSKFRLSYYPHCLASFTELLQAAFGGKCQHSVLGDFKPYKPGQTYIPCYFIHVLKRTD

SEQ ID NO: 47993 - protein, 449 aa, Homo sapiens
MYSFNTLRLYLWETIVFFSLAASKEAEAARSAPKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 47994 - protein, 457 aa, Homo sapiens
MYSFNTLRLYLWETIVFFSLAASKEAEAARSAPKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKSPMLNLFQEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 47995 - protein, 366 aa, Homo sapiens
MDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 47996 - protein, 452 aa, Homo sapiens [sequence omitted]

SEQ ID NO: 47997 - protein, 452 aa, Homo sapiens
MNRQLVNILTALFAFFLETNHFRTAFCKDHDSRSGKQPSQTLSPSDFLDKLMGRTSGYDARIRPNFKGPPVNVTCNIFINSFGSIAETTMDYRVNIFLRQQWNDSRLAYSEYPDDSLDLDPSMLDSIWKPDLFFANEKGANFHDVTTDNKLLRISKNGKVLYSIRLTLTLSCPMDLKNFPMDVQTCTMQLESFGYTMNDLIFEWLSDGPVQVAEGLTLPQFILKEEKELGYCTKHYNTGKFTCIEVKFHLERQMGYYLIQMYIPSLLIVILSWVSFWINMDAAPARVALGITTVLTMTTQSSGSRASLPKVSYVKAIDIWMAVCLLFVFAALLEYAAVNFVSRQHKEFLRLRRRQKRQNKEEDVTRESRFNFSGYGMGHCLQVKDGTAVKATPANPLPQPPKDGDAIKKKFVDRAKRIDTISRAAFPLAFLIFNIFYWITYKIIRHEDVHKK

SEQ ID NO: 47998 - protein, 215 aa, Homo sapiens
MNLHMRMTAFCKDHDSRSGKQPSQTLSPSDFLDKLMGRTSGYDARIRPNFKGPPVNVTCNIFINSFGSVTETTMDYRVNIFLRQQWNDSRLAYSEYPDDSLDLDPSMLDSIWKPDLFFANEKGANFHDVTTDNKLLRISKNGKVLYSIRLTLTLSCPMDLKNFPMDVQTCTMQLESFGYTMNDLIFEWLSDGPVQVAEGLTLPQFILKEEKELGY

SEQ ID NO: 47999 - protein, 363 aa, Homo sapiens
MDYRVNIFLRQQWNDSRLAYSEYPDDSLDLDPSMLDSIWKPDLFFANEKGANFHDVTTDNKLLRISKNGKVLYSIRLTLTLSCPMDLKNFPMDVQTCTMQLESFGYTMNDLIFEWLSDGPVQVAEGLTLPQFILKEEKELGYCTKHYNTGKFTCIEVKFHLERQMGYYLIQMYIPSLLIVILSWVSFWINMDAAPARVALGITTVLTMTTQSSGSRASLPKVSYVKAIDIWMAVCLLFVFAALLEYAAVNFVSRQHKEFLRLRRRQKRQNKEEDVTRESRFNFSGYGMGHCLQVKDGTAVKATPANPLPQPPKDGDAIKKKFVDRAKRIDTISRAAFPLAFLIFNIFYWITYKIIRHEDVHKK

SEQ ID NO: 48000 - protein, 464 aa, Homo sapiens
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESFGYTMNDLIFEWQDEAPVQVAEGLTLPQFLLKEEKDLRYCTKHYNTGKFTCIEVRFHLERQMGYYLIQMYIPSLLIVILSWVSFWINMDAAPARVALGITTVLTMTTQSSGSRASLPKVSYVKAIDIWMAVCLLFVFSALLEYAAVNFVSRQHKELLRFRRKRKNKTEAFALEKFYRFSDMDDEVRESRFSFTAYGMGPCLQAKDGMTPKGPNHPVQVMPKSPDEMRKVFIDRAKKIDTISRACFPLAFLIFNIFYWVIYKILRHEDIHQQQD

SEQ ID NO: 48001 - protein, 449 aa, Homo sapiens
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESFGYTMNDLIFEWQDEAPVQVAEGLTLPQFLLKEEKDLRYCTKHYNTGKFTCIEVRFHLERQMGYYLIQMYIPSLLIVILSWVSFWINMDAAPARVALGITTVLTMTTQSSGSRASLPKVSYVKAIDIWMAVCLLFVFSALLEYAAVNFVSRQHKELLRFRRKRKNKDDEVRESRFSFTAYGMGPCLQAKDGMTPKGPNHPVQVMPKSPDEMRKVFIDRAKKIDTISRACFPLAFLIFNIFYWVIYKILRHEDIHQQQD

SEQ ID NO: 48002 - protein, 497 aa, Homo sapiens
MKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGIFSVLSLASECTTLAAELPKVSYVKALDVWLIACLLFGFASLVEYAVVQVMLNNPKRVEAEKARIAKAEQADGKGGNVAKKNTVNGTGTPVHISTLQVGETRCKKVCTSKSDLRSNDFSIVGSLPRDFELSNYDCYGKPIEVNNGLGKSQAKNNKKPPPAKPVIPTAAKRIDLYARALFPFCFLFFNVIYWSIYL

SEQ ID NO: 48003 - protein, 497 aa, Homo sapiens; identical to SEQ ID NO: 48002

SEQ ID NO: 48004 - protein, 303 aa, Homo sapiens
MKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGW

SEQ ID NO: 48005 - protein, 163 aa, Homo sapiens
MMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPNGGKPKAM

SEQ ID NO: 48006 - protein, 296 aa, Homo sapiens
MMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPNGGKPKAINQEMFKLSSMDVTHAHLVNKFWHFGGNERSQRFIERCIQTFPTCCLLGPEGTPVCWDLMDQTGEMRMAGTLPEYRLHGLVTYVIYSHAQKLGKLGFPVYSHVDYSNEAMQKMSYTLQHVPIPRSWNQWNCVPL

SEQ ID NO: 48007 - protein, 296 aa, Homo sapiens; identical to SEQ ID NO: 48006

SEQ ID NO: 48008 - protein, 673 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 48009 - protein, 737 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 48010 - protein, 235 aa, Homo sapiens
MNSTWRTQCSSKWPGRWLTRVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPGIWTSTWTRPYTSLSPAAMSSPTRVLTSSWRHWLGSTICSE

SEQ ID NO: 48011 - protein, 657 aa, Homo sapiens
MNSTWRTQCSSKWPGRWLTRVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 48012 - protein, 370 aa, Homo sapiens
MPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 48013 - protein, 333 aa, Homo sapiens
MTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVFGASAKVVHFLGRVKPWNYTYDPKTKSVKSEAHDPNMTHPEFLILWWNIFTTNVLPLLQQFGLVKDTCSYVNVEDVSGAISHLSLGEIPAMAQPFVSSEERKERWEQGQADYMGADSFDNIKRKLDTYLQ

SEQ ID NO: 48014 - protein, 350 aa, Homo sapiens
MTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVFGASAKVVHFLGRVKPWNYTYDPKTKSVKSEAHDPNMTHPEFLILWWNIFTTNVLPLLQQFGLVKDTCSYVNVLSDLVYTLAFSCGFCRKEDVSGAISHLSLGEIPAMAQPFVSSEERKERWEQGQADYMGADSFDNIKRKLDTYLQ

SEQ ID NO: 48015 - protein, 279 aa, Homo sapiens
MTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVKMSQEPYHICPLGRSQLWHSRLYPRKNGRNDGNRARLIIWEQIPLTTSRGNLTLTSSRNTAFFCEHIHFTSLVSDT

SEQ ID NO: 48016 - protein, 465 aa, Homo sapiens
MSETEFHHGAQAGLELLRSSNSPTSASQSAGMTVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILVDLAVSVSQISIEEKVKELSPEEERRKWEEGRIDYMGKDAFARIQEKLDRFLQ

SEQ ID NO: 48017 - protein, 501 aa, Homo sapiens
MSETEFHHGAQAGLELLRSSNSPTSASQSAGMTVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 48018 - protein, 470 aa, Homo sapiens
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 48019 - protein, 138 aa, Homo sapiens
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGV

SEQ ID NO: 48020 - protein, 430 aa, Homo sapiens
MSETEFHHGAQAGLELLRSSNSPTSASQSAGMTVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDVDLAVSVSQISIEEKVKELSPEEERRKWEEGRIDYMGKDAFARIQEKLDRFLQ

SEQ ID NO: 48021 - protein, 117 aa, Homo sapiens
MYGKIIFVLLLSDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 48022 - protein, 150 aa, Homo sapiens
MYGKIIFVLLLSEIVSISALSTTEVAMHTSTSSSVTKSYISSQTNDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 48023 - protein, 62 aa, Homo sapiens
MYGKIIFVLLLSEIVSISALSTTEVAMHTSTSSSVTKSYISSQTNGERVQLAHHFSEPDFHN

SEQ ID NO: 48024 - protein, 118 aa, Homo sapiens
MYGKIIFVLLLSEIVSISALSTTEVAMHTSTSSSVTKSYISSQTNGERVQLAHHFSEPEITLIIFGVMAGVIGTILLISYGIRRLIKKSPSDVKPLPSPDTDVPLSSVEIENPETSDQ

SEQ ID NO: 48025 - protein, 137 aa, Homo sapiens
MYGKIIFVLLLSEIVSISALSTTEVAMHTSTSSSVTKSYISSQTNDTHKRDTYAATPRAHEVSEISVRTVYPPEEETEITLIIFGVMAGVIGTILLISYGIRRLIKKSPSDVKPLPSPDTDVPLSSVEIENPETSDQ

SEQ ID NO: 48026 - protein, 85 aa, Homo sapiens
MYGKIIFVLLLSGERVQLAHHFSEPEITLIIFGVMAGVIGTILLISYGIRRLIKKSPSDVKPLPSPDTDVPLSSVEIENPETSDQ

SEQ ID NO: 48027 - protein, 124 aa, Homo sapiens
MHTSTSSSVTKSYISSQTNDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 48028 - protein, 91 aa, Homo sapiens
MYGKIIFVLLLSEIVSISALSTTEVAMHTSTSSSVTKSYISSQTNGETGQLVHRFTVPAPVVIILIILCVMAGIIGTILLISYSIRRLIKA

SEQ ID NO: 48029 - protein, 91 aa, Homo sapiens; identical to SEQ ID NO: 48028

SEQ ID NO: 48030 - protein, 58 aa, Homo sapiens
MYGKIIFVLLLSGETGQLVHRFTVPAPVVIILIILCVMAGIIGTILLISYSIRRLIKA

SEQ ID NO: 48031 - protein, 128 aa, Homo sapiens
MWSTRSPNSTAWPLSLEPDPGMASASTTMHTTTIAEPDPGMSGWPDGRMETSTPTIMDIVVIAGVIAAVAIVLVSLLFVMLRYMYRHKGTYHTNEAKGTEFAESADAALQGDPALQDAGDSSRKEYFI

SEQ ID NO: 48032 - protein, 107 aa, Homo sapiens
MASASTTMHTTTIAEPDPGMSGWPDGRMETSTPTIMDIVVIAGVIAAVAIVLVSLLFVMLRYMYRHKGTYHTNEAKGTEFAESADAALQGDPALQDAGDSSRKEYFI

SEQ ID NO: 48033 - protein, 109 aa, Homo sapiens
MWSTRSPNSTAWPLSLEPDPGMSGWPDGRMETSTPTIMDIVVIAGVIAAVAIVLVSLLFVMLRYMYRHKGTYHTNEAKGTEFAESADAALQGDPALQDAGDSSRKEYFI

SEQ ID NO: 48034 - protein, 78 aa, Homo sapiens
MYGKIIFVLLLSGIVSISASSTTGVAMHTSTSSSVTKSYISSQTNGITLINWWAMARVIFEVMLVVVGMIILISYCIR

SEQ ID NO: 48035 - protein, 55 aa, Homo sapiens
MYGKIIFVLLLSGIVSISASSTTGVAMHTSTSSSVTKSYISSQTNGERGQLVHRF

SEQ ID NO: 48036 - protein, 78 aa, Homo sapiens; identical to SEQ ID NO: 48034

SEQ ID NO: 48037 - protein, 59 aa, Homo sapiens
MYGKIIFVLLLSGIVSISASSTTGVAMHTSTSSSVTKSYISSQTNGCVIGNIICSDKSK

SEQ ID NO: 48038 - protein, 534 aa, Homo sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 48039 - protein, 387 aa, Homo sapiens
MPHLMERMVGSGLLWLALVSCILTQASAVQRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 48040 - protein, 390 aa, Homo sapiens
MPHLMERMVGSGLLWLALVSCILTQASAVQRVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 48041 - protein, 537 aa, Homo sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 48042 - protein, 515 aa, Homo sapiens
MKIKCEKSRTQSSAQHVQHSAHSTIVCRKHSHNAETAGRVDIVRGGPFFHHPLRKWLISPPLNKPSVWPRTPIIPVHQLRRDTWVGNCNKKTAHSRLHSHGWPEEERFVFSSELHGKSAYSKVTCMPHLMERMVGSGLLWLALVSCILTQASAVQRDHLDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 48043 - protein, 652 aa, Homo sapiens
MPLLLLLLLLPSPLHPHPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKAMTSNVASVQCDNSDKFPVYKYPGKGCPTLGDEGDTDLYDYYPEEDTEGDKVRATRTVVKFPTKAHTTPWGLFYSWSTASLDSQMPSSLHPTQESTKEQTTFPPRWTPNFTLHMESITFSKTPKSTTEPTPSPTTSEPVPEPAPNMTTLEPTPSPTTPEPTSEPAPSPTTPEPTSEPAPSPTTPEPTSEPAPSPTTPEPTPIPTIATSPTILVSATSLITPKSTFLTTTKPVSLLESTKKTIPELDQPPKLRGVLQGHLESSRNDPFLHPDFCCLLPLGFYVLGLFWLLFASVVLILLLSWVGHVKPQALDSGQGAALTTATQTTHLELQRGRQVTVPRAWLLFLRGSLPTFRSSLFLWVRPNGRVGPLVAGRRPSALSQGRGQDLLSTVSIRYSGHSL

SEQ ID NO: 48044 - protein, 626 aa, Homo sapiens
MPLLLLLLLLPSPLHPHPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKAMTSNVASVQCDNSDKFPVYKYPGKGCPTLGDEGDTDLYDYYPEEDTEGDKVRATRTVVKFPTKAHTTPWGLFYSWSTASLDSQMPSSLHPTQESTKEQTTFPPRWTPNFTLHMESITFSKTPKSTTEPTPSPTTSEPVPEPAPNMTTLEPTPSPTTPEPTSEPAPSPTTPEPTPIPTIATSPTILVSATSLITPKSTFLTTTKPVSLLESTKKTIPELDQPPKLRGVLQGHLESSRNDPFLHPDFCCLLPLGFYVLGLFWLLFASVVLILLLSWVGHVKPQALDSGQGAALTTATQTTHLELQRGRQVTVPRAWLLFLRGSLPTFRSSLFLWVRPNGRVGPLVAGRRPSALSQGRGQDLLSTVSIRYSGHSL

SEQ ID NO: 48045 - protein, 206 aa, Homo sapiens
MGSGPRGALSLLLLLLAPPSRPAAGCPAPCSCAGTLVDCGRRGLTWASLPTAFPVDTTELVLTGNNLTALPPGLLDALPALRTAHLGANPWRCDCRLVPLRAWLAGRPERAPYRDLRCVAPPALRGRLLPYLAEDELRAACAPGPLCWGALAAQLALLGLGLLHALLLVLLLCRLRRLRARARARAAARLSLTDPLVAERAGTDES

SEQ ID NO: 48046 - protein, 409 aa, Homo sapiens
MIPSRHTMLRFLPVNAASCPGDRRTMLVNVAAGVRVLRVPLRAGGSGSLSGLRPPAIVCYLPLQRASASGLFLARPQHCGRCGRGRGGAALSLGSPAYASRCRVSRAAVFSPWAPVSLESGRAPGCSLGRPGLRGALVVWLQLGETWVRLRGDFQPACGVVRVERLAGYRDAGHQGLDGAGPAVWVLRDVAQVPADRSAYCGASLAGPRGALSLLLLLLAPPSRPAAGCPAPCSCAGTLVDCGRRGLTWASLPTAFPVDTTELVLTGNNLTALPPGLLDALPALRTAHLGANPWRCDCRLVPLRAWLAGRPERAPYRDLRCVAPPALRGRLLPYLAEDELRAACAPGPLCWGALAAQLALLGLGLLHALLLVLLLCRLRRLRARARARAAARLSLTDPLVAERAGTDES

SEQ ID NO: 48047 - protein, 177 aa, Homo sapiens
MPAWGALFLLWATAEATKDCPSPCTCRALETMGLWVDCRGHGLTALPALPARTRHLLLANNSLQSVPPGAFDHLPQLQTLDVTQNPWHCDCSLTYLRLWLEDRTPEALLQVRCASPSLAAHGPLGRLTGYQLGSCGWQLQASWVRPGVLWDVALVAVAALGLALLAGLLCATTEALD

SEQ ID NO: 48048 - protein, 328 aa, Homo sapiens
MKPAMETAAEENTEQSQERKVNSRAEMEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALIHFLMILSSNWAYLKDASKMQAYQDIKAKEEQELQDIQSRSKEQLNSYT

SEQ ID NO: 48049 - protein, 305 aa, Homo sapiens
MKPAMETAAEENTEQSQERKVNSRAEMEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 48050 - protein, 265 aa, Homo sapiens
MKPAMETAAEENTEQSQERKGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 48051 - protein, 179 aa, Homo sapiens
MQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 48052 - protein, 246 aa, Homo sapiens
MGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 48053 - protein, 107 aa, Homo sapiens
MKPAMETAAEENTEQSQERKGCFECCIKCLGGVPYASLVATILCFSGVALFCGCGHVALAGTVAILEQHFSTNASDHALLSEVIQLMQYVIYGIASFFFLYGIILLA

SEQ ID NO: 48054 - protein, 302 aa, Homo sapiens
MEIGRYHWMYPGSKNHQYHPVPTLGDRASPLSSPGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALIHFLMILSSNWAYLKDASKMQAYQDIKAKEEQELQDIQSRSKEQLNSYT

SEQ ID NO: 48055 - protein, 620 aa, Homo sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGESCPPVLHQGQPGPDMPRGCDPNNPGGVSGRGLAQPEEAPAAQGQGCAEAASAPPAPPADPEIKRGSGWRPTGCSQPRVMFMTAEPQARSYPREGSWHGRRLKDWRVWSVEAGGQRLQLWKRGHAASSWCSIREPFGQCLSVCLPLCLRAPSIWDGRNLWRPHPPPCTLWMTWYPGWTTYWPLSSTSLIWAPDGSLRFPALRVDSVPSSVQNPPVLPFGPLCSCLVFPRNSHPHSISHCGLTNLLSSLRTGLAGSLGMSFIFLSVKLARCPLPFTLENKISLCNMVKPHLYQQNKKTQKLARCGGASLYSQQLRGLRWENGLSLGGRGCSELRSHHCTLARVTKPDFVSKNTGMNMSITLI

SEQ ID NO: 48056 - protein, 321 aa, Homo sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTEFSEATAELTVSFTNEVFTTETSRSITASPKESDSPAGPARQYYTKGNLVRICLGAVILIILAGFLAEDWHSRRKRLRHRGRAVQRPLPPLPPLPLTRKSNGGQDGGRQDVHSRGLCS

SEQ ID NO: 48057 - protein, 339 aa, Homo sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGPARQYYTKGNLVRICLGAVILIILAGFLAEDWHSRRKRLRHRGRAVQRPLPPLPPLPLTRKSNGGQDGGRQDVHSRGLCS

SEQ ID NO: 48058 - protein, 621 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 48059 - protein, 561 aa, Homo sapiens
MGLLSDPVRRRALARLVLRLNAPLWALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 48060 - protein, 184 aa, Homo sapiens
MKALGAVLLALLLCGRPGRGQTQQEEEEEDEDHGPDDYDEEDEDEVEEEETNRLPGGRSRVLLRCYTCKSLPRDERCNLTQNCSHGQTCTTLIAHGNTESGLLTTHSTWCTDSCQPITKTVEGTQVTMTCCQSSLCNVPPWQSSRVQDPTGKGAGGPRGSSETVGAALLLNLLAGLGAMGARRP

SEQ ID NO: 48061 - protein, 158 aa, Homo sapiens
MLLFALLLAMELPLVAASATMRAQWTYSLRCHDCAVINDFNCPNIRVCPYHIRRCMTISIRINSRELLVYKNCTNNCTFVYAAEQPPEAPGKIFKTNSFYWVCCCNSMVCNAGGPTNLERDMLPDEVTEEELPEGTVRLGVSKLLLSFASIIVSNILP

SEQ ID NO: 48062 - protein, 840 aa, Homo sapiens
MSAFRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGGDVLSQFEFNFNYLARRWYVPVKDLLGIYEKLYGRKVITENVIVDCSHIQFLEMYGEMLAVSKLYPTYSTKSPFLVEQFQEYFLGGLDDMAFWSTNIYHLTSFMLENGTSDCNLPENPLFIACGGQQNHTQGSKMQKNDFHRNLTTSLTESVDRNINYTERGVFFSVNSWTPDSMSFIYKALERNIRTMFIGGSQLSQKHVSSPLASYFLSFPYARLGWAMTSADLNQDGHGDLVVGAPGYSRPGHIHIGRVYLIYGNDLGLPPVDLDLDKEAHRILEGFQPSGRFGSALAVLDFNVDGVPDLAVGAPSVGSEQLTYKGAVYVYFGSKQGGMSSSPNITISCQDIYCNLGWTLLAADVNGDSEPDLVIGSPFAPGGGKQKGIVAAFYSGPSLSDKEKLNVEAANWTVRGEEDFSWFGYSLHGVTVDNRTLLLVGSPTWKNASRLGHLLHIRDEKKSLGRVYGYFPPNGQSWFTISGDKAMGKLGTSLSSGHVLMNGTLKQVLLVGAPTYDDVSKVAFLTVTLHQGGATRMYALTSDAQPLLLSTFSGDRRFSRFGGVLHLSDLDDDGLDEIIMAAPLRIADVTSGLIGGEDGRVYVYNGKETTLGDMTGKCKSWITPCPEEKAQYVLISPEASSRFGSSLITVRSKAKNQVVIAAGRSSLGARLSGALHVYSLGSD

SEQ ID NO: 48063 - protein, 176 aa, Homo sapiens
MSAFRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGTVYLHLLNFLVV

SEQ ID NO: 48064 - protein, 276 aa, Homo sapiens
MNSKRMLLLVLFAFSLMLVERYFRNHQVEELRLSDWFHPRKRPDVITKTDWLAPVLWEGTFDRRVLEKHYRRRNITVGLAVFATGRFAEEYLRPFLHSANKHFMTGYRVIFYIMVDAFFKLPDIEPSPLRTFKAFKVGTERWWLDGPLVHVKSLGEHIASHIQDEVDFLFSMAANQVFQNEFGVETLGPLVAQLHAWWYFRNTKNFPYERRPTSAACIPFGQGDFYYGNLMVGGTPHNILDFIKEYLNGVIHDIKNGLNSTYEKHLNKYFYLNKPT

SEQ ID NO: 48065 - protein, 721 aa, Homo sapiens
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 48066 - protein, 289 aa, Homo sapiens
MWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLREARAGFNSSSTCGCAHPSHQARWPMVV

SEQ ID NO: 48067 - protein, 721 aa, Homo sapiens; identical to SEQ ID NO: 48065

SEQ ID NO: 48068 - protein, 721 aa, Homo sapiens; identical to SEQ ID NO: 48065

SEQ ID NO: 48069 - protein, 690 aa, Homo sapiens
MLPRGRPRALGAAALLLLLLLLGFLLFDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 48070 - protein, 373 aa, Homo sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 48071 - protein, 458 aa, Homo sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 48072 - protein, 373 aa, Homo sapiens; identical to SEQ ID NO: 48070

SEQ ID NO: 48073 - protein, 458 aa, Homo sapiens; identical to SEQ ID NO: 48071

SEQ ID NO: 48074 - protein, 458 aa, Homo sapiens; identical to SEQ ID NO: 48071

SEQ ID NO: 48075 - protein, 99 aa, Homo sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVK

SEQ ID NO: 48076 - protein, 173 aa, Homo sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVS

SEQ ID NO: 48077 - protein, 458 aa, Homo sapiens; identical to SEQ ID NO: 48071

SEQ ID NO: 48078 - protein, 739 aa, Homo sapiens
MPSPRPVLLRGARAALLLLLPPRLLARPSLLLRRSLSAASCPPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 48079 - protein, 184 aa, Homo sapiens
MAEPQPPSGGLTDEAALSCCSDADPSTKDFLLQQTMLRVKDPKKSLDFYTRVLGMTLIQKCDFPIMKFSLYFLAYEDKNDIPKEKDEKIAWALSRKATLELTHNWGTEDDETQSYHNGNSDPRGFGHIGIAVPDVYSACKRFEELGVKFVKKPDDGKMKGLAFIQDPDGYWIEILNPNKMATLM

SEQ ID NO: 48080 - protein, 328 aa, Homo sapiens
MRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRGDVVNQDDLYQALASGKIAAAGLDVTSPEPLPTNHPLLTLKNCVILPHIGSATHRTRNTMSLLAANNLLAGLRGEPMPSELKL

SEQ ID NO: 48081 - protein, 395 aa, Homo sapiens
MRPVRLMKVFVTRRIPAEGRVALARAADCEVEQWDSDEPIPAKELERGVAGAHGLLCLLSDHVDKRILDAAGANLKVISTMSVGIDHLALDEIKKRGIRVGYTPDVLTDTTAELAVSLLLTTCRRLPEAIEEVKNGGWTSWKPLWLCGYGLTQSTVGIIGLGRIGQAIARRLKPFGVQRFLYTGRQPRPEEAAEFQAEFVSTPELAAQSDFIVVACSLTPATEGLCNKDFFQKMKETAVFINISRYPRATLPSKPGEEPSPLLPSGDFLPRGLLVRPQAELAGFHKPNNQLRNSWEYTRPPYREEEPSEWAWPVCFSAVAPTRRGLAHSSVASGSVPREPLQAHYPPPQRAGLEDLKGPLEAASHTAEPGFVWLWFSDTLNLMLLGGQTLKLTWS

SEQ ID NO: 48082 - protein, 252 aa, Homo sapiens
MLGGVPTLCGTGNETWTLLALGQAIARRLKPFGVQRFLYTGRQPRPEEAAEFQAEFVSTPELAAQSDFIVVACSLTPATEGLCNKDFFQKMKETAVFINISRYPRATLPSKPGEEPSPLLPSGDFLPRGLLVRPQAELAGFHKPNNQLRNSWEYTRPPYREEEPSEWAWPVCFSAVAPTRRGLAHSSVASGSVPREPLQAHYPPPQRAGLEDLKGPLEAASHTAEPGFVWLWFSDTLNLMLLGGQTLKLTWS

SEQ ID NO: 48083 - protein, 558 aa, Homo sapiens
MELRARGWWLLCAAAALVACARGDPASKSRSCGEVRQIYGAKGFSLSDVPQAEISGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCSRKVSRKSSSSRTPLTHALPGLSEQEGQKTSAASCPQPPTFLLPLLLFLALTVARPRWR

SEQ ID NO: 48084 - protein, 580 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 48085 - protein, 603 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTETEKKIWHFKYPIFFLCIGLDLQIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 48086 - protein, 256 aa, Homo sapiens
  MOD_RES (1)..(1): Any amino acid
XKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAGN

SEQ ID NO: 48087 - protein, 526 aa, Homo sapiens
MAGTVRTACLVVAMLLSLDFPGQAQPPPPPPDATCHQVRSFFQRLQPGLKWVPETPVPEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 48088 - protein, 556 aa, Homo sapiens
MARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVVNPTAQCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 48089 - protein, 486 aa, Homo sapiens
MEEKYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVVNPTAQCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 48090 - protein, 550 aa, Homo sapiens
MARFGLPALLCTLAVLSAALLAAELKSKSCSEVRRLYVSKGFNKNDAPLHEINGDHEDLSPGFYLLLSRDGGYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVPSCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 48091 - protein, 572 aa, Homo sapiens
MDAQTWPVGFRCLLLLALVGSARSEGVQTCEEVRKLFQWRLLGAVRGLPDSPRAGPDLQVCISKKPTCCTRKMEERYQIAARQDMQQFLQTSSSTLKFLISRNAAAFQETLETLIKQAENYTSILFCSTYRNMALEAAASVQEFFTDVGLYLFGADVNPEEFVNRFFDSLFPLVYNHLINPGVTDSSLEYSECIRMARRDVSPFGNIPQRVMGQMGRSLLPSRTFLQALNLGIEVINTTDYLHFSKECSRALLKMQYCPHCQGLALTKPCMGYCLNVMRGCLAHMAELNPHWHAYIRSLEELSDAMHGTYDIGHVLLNFHLLVNDAVLQAHLNGQKLLEQVNRICGRPVRTPTQSPRCSFDQSKEKHGMKTTTRNSEETLANRRKEFINSLRLYRSFYGGLADQLCANELAAADGLPCWNGEDIVKSYTQRVVGNGIKAQSGNPEVKVKGIDPVINQIIDKLKHVVQLLQGRSPKPDKWELLQLGSGGGMVEQVSGDCDDEDGCGGSGSGEVKRTLKITDWMPDDMNFSDVKQIHQTDTGSTLDTTGAGCAVATESMTFTLISVVMLLPGIW

SEQ ID NO: 48092 - protein, 555 aa, Homo sapiens
MPSWIGAVILPLLGLLLSLPAGADVKARSCGEVRQAYGAKGFSLADIPYQEIAGEHLRICPQEYTCCTTEMEDKLSQQSKLEFENLVEETSHFVRTTFVSRHKKFDEFFRELLENAEKSLNDMFVRTYGMLYMQNSEVFQDLFTELKRYYTGGNVNLEEMLNDFWARLLERMFQLINPQYHFSEDYLECVSKYTDQLKPFGDVPRKLKIQVTRAFIAARTFVQGLTVGREVANRVSKVSPTPGCIRALMKMLYCPYCRGLPTVRPCNNYCLNVMKGCLANQADLDTEWNLFIDAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 48093 - protein, 193 aa, Homo sapiens
MQSLMQAPLLIALGLLLAAPAQAHLKKPSQLSSFSWDNCDEGKDPAVIRSLTLEPDPIIVPGNVTLSVMGSTSVPLSSPLKVDLVLEKEVAGLWIKIPCTDYIGSCTFEHFCDVLDMLIPTGEPCPEPLRTYGLPCHCPFKEGTYSLPKSEFVVPDLELPSWLTTGNYRIESVLSSSGKRLGCIKIAASLKGI

SEQ ID NO: 48094 - protein, 379 aa, Homo sapiens
MGCLGNSKTEDQRNEEKAQREANKKIEKQLQKDKQVYRATHRLLLLGAGESGKSTIVKQMRILHVNGFNGDEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 48095 - protein, 380 aa, Homo sapiens
MGCLGNSKTEDQRNEEKAQREANKKIEKQLQKDKQVYRATHRLLLLGAGESGKSTIVKQMRILHVNGFNGDSEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 48096 - protein, 245 aa, Homo sapiens
MDRRSRAQQWRRARHNYNDLCPPIGRRAATALLWLSCSIALLRALATSNARAQQRAAAQQRRSFLNAHHRSGAQVFPESPESESDHEHEEADLELSLPECLEYEEEFDYETESETESEIESETDFETEPETAPTTEPETEPEDDRGPVVPKHSTFGQSLTQRLHALKLRSPDASPSRAPPSTQEPQSPREGEELKPEDKDPRDPEESKEPKEEKQRRRCKPKKPTRRDASPESPSKKGPIPIRRH

SEQ ID NO: 48097 - protein, 395 aa, Homo sapiens
MGCLGNSKTEDQRNEEKAQREANKKIEKQLQKDKQVYRATHRLLLLGAGESGKSTIVKQMRILHVNGFNGEGGEEDPQAARSNSDGSEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 48098 - protein, 245 aa, Homo sapiens; identical to SEQ ID NO: 48096

SEQ ID NO: 48099 - protein, 160 aa, Homo sapiens
MGCLGNSKTEDQRNEEKAQREANKEDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 48100 - protein, 394 aa, Homo sapiens
MGCLGNSKTEDQRNEEKAQREANKKIEKQLQKDKQVYRATHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 48101 - protein, 380 aa, Homo sapiens; identical to SEQ ID NO: 48095

SEQ ID NO: 48102 - protein, 245 aa, Homo sapiens; identical to SEQ ID NO: 48096

SEQ ID NO: 48103 - protein, 1037 aa, Homo sapiens
MGVRNCLYGNNMSGQRDIPPEIGEQPEQPPLEAPGAAAPGAGPSPAEEMETEPPHNEPIPVENDGEACGPPEVSRPNFQVLNPAFREAGAHGSYSPPPEEAMPFEAEQPSLGGFWPTLEQPGFPSGVHAGLEAFGPALMEPGAFSGARPGLGGYSPPPEEAMPFEFDQPAQRGCSQLLLQVPDLAPGGPGAAGVPGAPPEEPQALRPAKAGSRGGYSPPPEETMPFELDGEGFGDDSPPPGLSRVIAQVDGSSQFAAVAASSAVRLTPAANAPPLWVPGAIGSPSQEAVRPPSNFTGSSPWMEISGPPFEIGSAPAGVDDTPVNMDSPPIALDGPPIKVSGAPDKRERAERPPVEEEAAEMEGAADAAEGGKVPSPGYGSPAAGAASADTAARAAPAAPADPDSGATPEDPDSGTAPADPDSGAFAADPDSGAAPAAPADPDSGAAPDAPADPDSGAAPDAPADPDAGAAPEAPAAPAAAETRAAHVAPAAPDAGAPTAPAASATRAAQVRRAASAAPASGARRKIHLRPPSPEIQAADPPTPRPTRASAWRGKSESSRGRRVYYDEGVASSDDDSSGDESDDGTSGCLRWFQHRRNRRRRKPQRNLLRNFLVQAFGGCFGRSESPQPKASRSLKVKKVPLAEKRRQMRKEALEKRAQKRAEKKRSKLIDKQLQDEKMGYMCTHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 48104 - protein, 113 aa, Homo sapiens
  MOD_RES (1)..(1): Any amino acid
XTTEPETEPEDDRGPVVPKHSTFGQSLTQRLHALKLRSPDASPSRAPPSTQEPQSPREGEELKPEDKDPRDPEESKEPKEEKQRRRCKPKKPTRRDASPESPSKKGPIPIRRH

SEQ ID NO: 48105 - protein, 166 aa, Homo sapiens
PESESDHEHEEADLELSLPECLEYEEEFDYETESETESEIESETDFETEPETAPTTEPETEPEDDRGPVVPKHSTFGQSLTQRLHALKLRSPDASPSRAPPSTQEPQSPREGEELKPEDKDPRDPEESKEPKEEKQRRRCKPKKPTRRDASPESPSKKGPIPIRRH

SEQ ID NO: 48106 - protein, 1859 aa, Homo sapiens
MVDKNIYIIQGEINIVVGAIKRNARWSTHTPLDEERDPLLHSFGHLKEVLNSITELSEIEPNVFLRPFLEVIRSEDTTGPITGLALTSVNKFLSYALIDPTHEGTAEGMENMADAVTHARFVGTDPASDEVVLMKILQVLRTLLLTPVGAHLTNESVCEIMQSCFRICFEMRLSELLRKSAEHTLVDMVQLLFTRLPQFKEEPKNYVGTNMKKLKMRAGGMSDSSKWKKQKRSPRPPRHMTKVTPGSELPTPNGTTLSSNLTGGMPFIDVPTPISSASSEAASAVVSPSTDSGLEFSSQTTSKEDLTDLEQPGSPGYSTATEPGSSELGVPEQPDLQEGTHVEKSQSASVESIPEVLEECTSPADHSDSASVHDMDYVNPRGVRFTQSSQKEGTALVPYGLPCIRELFRFLISLTNPHDRHNSEVMIHMGLHLLTVALESAPVAQCQTLLGLIKDEMCRHLFQLLSIERLNLYAASLRVCFLLFESMREHLKFQMEMYIKKLMEIITVENPKMPYEMKEMALEAIVQLWRIPSFVTELYINYDCDYYCSNLFEELTKLLSKNAFPVSGQLYTTHLLSLDALLTVIDSTEAHCQAKVLNSLTQQEKKETARPSCEIVDGTREASNTERTASDGKAVGMASDIPGLHLPGGGRLPPEHGKSGCSDLEEAVDSGADKKFARKPPRFSCLLPDPRELIEIKNKKKLLITGTEQFNQKPKKGIQFLQEKGLLTIPMDNTEVAQWLRENPRLDKKMIGEFVSDRKNIDLLESFVSTFSFQGLRLDEALRLYLEAFRLPGEAPVIQRLLEAFTERWMNCNGSPFANSDACFSLAYAVIMLNTDQHNHNVRKQNAPMTLEEFRKNLKGVNGGKDFEQDILEDMYHAIKNEEIVMPEEQTGLVRENYVWNVLLHRGATPEGIFLRVPTASYDLDLFTMTWGPTIAALSYVFDKSLEETIIQKAISGFRKCAMISAHYGLSDVFDNLIISLCKFTALSSESIENLPSVFGSNPKAHIAAKTVFHLAHRHGDILREGWKNIMEAMLQLFRAQLLPKAMIEVEDFVDPNGKISLQREETPSNRGESTVLSFVSWLTLSGPEQSSVRGPSTENQEAKRVALECIKQCDPEKMITESKFLQLESLQELMKALVSVTPDEETYDEEDAAFCLEMLLRIVLENRDRVGCVWQTVRDHLYHLCVQAQDFCFLVERAVVGLLRLAIRLLRREEISAQVLLSLRILLLMKPSVLSRVSHQVAYGLHELLKTNAANIHSGDDWATLFTLLECIGSGVKPPAALQATARADAPDAGAQSDSELPSYHQNDVSLDRGYTSDSEVYTDHGRPGKIHRSATDADVVNSGWLVVGKDDVDNSKPGPSRPGPSPLINQYSLTVGLDLGPHDTKSLLKCVESLSFIVRDAAHITPDNFELCVKTLRIFVEASLNGGCKSQEKRGKSHKYDSKGNRFKKKSKEGSMLRRPRTSSQHASRGGQSDDDEDEGVPASYHTVSLQVSQDLLDLMHTLHTRAASIYSSWAEEQRHLETGGQKIEADSRTLWAHCWCPLLQGIACLCCDARRQVRMQALTYLQRALLVHDLQKLDALEWESCFNKVLFPLLTKLLENISPADVGGMEETRMRASTLLSKVFLQHLSPLLSLSTFAALWLTILDFMDKYMHAGSSDLLSEAIPESLKNMLLVMDTAEIFHSADARGGGPSALWEITWERIDCFLPHLRDELFKQTVIQDPMPMEPQGQKPLASAHLTSAAGDTRTPGHPPPPEIPSELGACDFEKPESPRAASSSSPGSPVASSPSRLSPTPDGPPPLAQPPLILQPLASPLQVGVPPMTLPIILNPALIEATSPVPLLATPRPTDPIPTSEVN

SEQ ID NO: 48107 - protein, 1203 aa, Homo sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDRLQYRSETMAYKGLVWSQDVTGSPA

SEQ ID NO: 48108 - protein, 1179 aa, Homo sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 48109 - protein, 1192 aa, Homo sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVRELLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDRLQYRSETMAYKGLVWSQDVTGSPA

SEQ ID NO: 48110 - protein, 696 aa, Homo sapiens
MGNGMCSRKQKRIFQTLLLLTVVFGFLYGAMLYYELQTQLRKAEAVALKYQQHQESLSAQLQVVYEHRSRLEKSLQKERLEHKKAKEDFLVYKLEAQETLNKGRQDSNSRYSALNVQHQMLKSQHEELKKQHSDLEEEHRKQGEDFSRTFNDHKQKYLQLQQEKEQELSKLKETVYNLREENRQLRKAHQDIHTQLQDVKQQHKNLLSEHEQLVVTLEDHKSALAAAQTQVAEYKQLKDTLNRIPSLRKPDPAEQQNVTQVAHSPQGYNTAREKPTREVQEVSRNNDVWQNHEAVPGRAEDTKLYAPTHKEAEFQAPPEPIQQEVERREPEEHQVEEEHRKALEEEEMEQVGQAEHLEEEHDPSPEEQDREWKEQHEQREAANLLEGHARAEVYPSAKPMIKFQSPYEEQLEQQRLAVQQVEEAQQLREHQEALHQQRLQGHLLRQQEQQQQQVAREMALQRQAELEEGRPQHQEQLRQQAHYDAMDNDIVQGAEDQGIQGEEGAYERDNQHQDEAEGDPGNRHEPREQGPREADPESEADRAAVEDINPADDPNNQGEDEFEEAEQVREENLPDENEEQKQSNQKQENTEVEEHLVMAGNPDQQEDNVDEQYQEEAEEEVQEDLTEEKKRELEHNAEETYGENDENTDDKNNDGEEQEVRDDNRPKGREEHYEEEEEEEEDGAAVAEKSHRRAEM

SEQ ID NO: 48111 - protein, 298 aa, Homo sapiens
MTSLTQRSSGLVQRRTEASRNAADKERAAGGGAGSSEDDAQSRRDEQDDDDKGDSKETRLTLMEEVLLLGLKDREGYTSFWNDCISSGLRGCMLIELALRGRLQLEACGMRRKSLLTRKVICKSDAPTGDVLLDEALKHVKETQPPETVQNWIELLSGETWNPLKLHYQLRNVRERLAKNLVEKGVLTTEKQNFLLFDMTTHPLTNNNIKQRLIKKVQEAVLDKWVNDPHRMDRRLLALIYLAHASDVLENAFAPLLDEQYDLATKRVRQLLDLDPEVECLKANTNEVLWAVVAAFTK

SEQ ID NO: 48112 - protein, 281 aa, Homo sapiens
MTSLTQRSSGLVQRRTEASRNAADSRRDEQDDDDKGDSKETRLTLMEEVLLLGLKDREGYTSFWNDCISSGLRGCMLIELALRGRLQLEACGMRRKSLLTRKVICKSDAPTGDVLLDEALKHVKETQPPETVQNWIELLSGETWNPLKLHYQLRNVRERLAKNLVEKGVLTTEKQNFLLFDMTTHPLTNNNIKQRLIKKVQEAVLDKWVNDPHRMDRRLLALIYLAHASDVLENAFAPLLDEQYDLATKRVRQLLDLDPEVECLKANTNEVLWAVVAAFTK

SEQ ID NO: 48113 - protein, 285 aa, Homo sapiens
MTTLTHRARRTEISKNSEKKMESEEDSNWEKSPDNEDSGDSKDIRLTLMEEVLLLGLKDKEGYTSFWNDCISSGLRGGILIELAMRGRIYLEPPTMRKKRLLDRKVLLKSDSPTGDVLLDETLKHIKATEPTETVQTWIELLTGETWNPFKLQYQLRNVRERIAKNLVEKGILTTEKQNFLLFDMTTHPVTNTTEKQRLVKKLQDSVLERWVNDPQRMDKRTLALLVLAHSSDVLENVFSSLTDDKYDVAMNRAKDLVELDPEVEGTKPSATEMIWAVLAAFNKS

SEQ ID NO: 48114 - protein, 307 aa, Homo sapiens
MTTLTHRARRTEISKNSEKKMESEEDSNWEKSPDNEDSGDSKDIRLTLMEEVLLLGLKDKEANINSWITRWLTPVIPALWGAEGYTSFWNDCISSGLRGGILIELAMRGRIYLEPPTMRKKRLLDRKVLLKSDSPTGDVLLDETLKHIKATEPTETVQTWIELLTGETWNPFKLQYQLRNVRERIAKNLVEKGILTTEKQNFLLFDMTTHPVTNTTEKQRLVKKLQDSVLERWVNDPQRMDKRTLALLVLAHSSDVLENVFSSLTDDKYDVAMNRAKDLVELDPEVEGTKPSATEMIWAVLAAFNKS

SEQ ID NO: 48115 - protein, 269 aa, Homo sapiens
MTTLTHRARRTEISKNSEKKMESEEDSNWEKSPDNEDSGDSKDIRLTLMEEVLLLGLKDKEANINSWITRWLTPVIPALWGAEGYTSFWNDCISSGLRGGILIELAMRGRIYLEPPTMRKKRLLDRKVLLKSDSPTGDVLLDETLKHIKATEPTETVQTWIELLTGETWNPFKLQYQLRNVRERIAKNLVEKGILTTEKQNFLLFDMTTHPVTNTTEKQRLVKKLQDSVLERWVNDPQRMDKRTLALLVLAHSSDVLENVFSSLTDDKY

SEQ ID NO: 48116 - protein, 241 aa, Homo sapiens
MTTLTHRARRTEISKNSEKKMESEEDSNWEKSPDNEDSGDSKDIRLTLMEEVLLLGLKDKEVLLKSDSPTGDVLLDETLKHIKATEPTETVQTWIELLTGETWNPFKLQYQLRNVRERIAKNLVEKGILTTEKQNFLLFDMTTHPVTNTTEKQRLVKKLQDSVLERWVNDPQRMDKRTLALLVLAHSSDVLENVFSSLTDDKYDVAMNRAKDLVELDPEVEGTKPSATEMIWAVLAAFNKS

SEQ ID NO: 48117 - protein, 440 aa, Homo sapiens
MGLGVSAEQPAGGAEGFHLHGVQENSPAQQAGLEPYFDFIITIGHSRLNKENDTLKALLKANVEKPVKLEVFNMKTMRVREVEVVPSNMWGGQGLLGASVRFCSFRRASEQVWHVLDVEPSSPAALAGLRPYTDYVVGSDQILQESEDFFTLIESHEGKPLKLMVYNSKSDSCREVTVTPNAAWGGEGSLGCGIGYGYLHRIPTQPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGLDTGTEAEGLDSQAQISTTE

SEQ ID NO: 48118 - protein, 250 aa, Homo sapiens
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 48119 - protein, 185 aa, Homo sapiens
MFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 48120 - protein, 174 aa, Homo sapiens
MAAGTSSYWEDLRKQARQLENELDLKLVSFSKLCTSYSHSSTRDGRRDSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRKGFQW

SEQ ID NO: 48121 - protein, 248 aa, Homo sapiens
MAAGTSSYWEDLRKQARQLENELDLKLVSFSKLCTSYSHSSTRDGRRDSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 48122 - protein, 175 aa, Homo sapiens
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQVIYWARDVFIITGVWVFFFNPCIGYVHIYLKGQREKSEKINAMLKGLVLLFFGVTIIKF

SEQ ID NO: 48123 - protein, 185 aa, Homo sapiens; identical to SEQ ID NO: 48119

SEQ ID NO: 48124 - protein, 213 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGTQGSCQTAHFGGRSAGSS

SEQ ID NO: 48125 - protein, 212 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTCVVMFLVVQYLT

SEQ ID NO: 48126 - protein, 195 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKVGSLLGDREKASCFSLIQQFSNCVYILITCPQIVIF

SEQ ID NO: 48127 - protein, 232 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIETRSHHVAQNGPELLSSRDPPASASRSAGIIEFSEKIT

SEQ ID NO: 48128 - protein, 327 aa, Homo sapiens
MAAAAAMAEQESARNGGRNRGGVQRVEGKLRASVEKGDYYEAHQMYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGGKLTVFTVLCEQYQPSLRRDPMYNEYLDRIGQLFFGVPPKQTSSYGGLLGNLLTSLMGSSEQEDGEESPSDGSPIELD

SEQ ID NO: 48129 - protein, 592 aa, Homo sapiens
MALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKKQVLSFLGKACLQPWGQAILLTTSCLA

SEQ ID NO: 48130 - protein, 651 aa, Homo sapiens
MKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 48131 - protein, 454 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 48132 - protein, 462 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLSGPSVEELERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 48133 - protein, 462 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLVSRSSSKMERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 48134 - protein, 552 aa, Homo sapiens
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 48135 - protein, 38 aa, Homo sapiens
MKSCGKRFHDEVGKFRFLNELIKVVSPKYLGSRTSEKV

SEQ ID NO: 48136 - protein, 606 aa, Homo sapiens
MEPAMEPETLEARINRATNPLNKELDWASINGFCEQLNEDFEGPPLATRLLAHKIQSPQEWEAIQALTYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 48137 - protein, 639 aa, Homo sapiens
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 48138 - protein, 656 aa, Homo sapiens
MEPAMEPETLEARINRATNPLNKELDWASINGFCEQLNEDFEGPPLATRLLAHKIQSPQEWEAIQALTVRRGEATIRPPPCDDTKVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 48139 - protein, 566 aa, Homo sapiens
MKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 48140 - protein, 40 aa, Homo sapiens
MKSCGKRFHDEVGKFRFLNELIKVVSPKYLGSRTSEKVKN

SEQ ID NO: 48141 - protein, 109 aa, Homo sapiens
MKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLL

SEQ ID NO: 48142 - protein, 89 aa, Homo sapiens
MEPAMEPETLEARINRATNPLNKELDWASINGFCEQLNEDFEGPPLATRLLAHKIQSPQEWEAIQALTVRRGEATIRPPPCDDTKGGQD

SEQ ID NO: 48143 - protein, 109 aa, Homo sapiens; identical to SEQ ID NO: 48141

SEQ ID NO: 48144 - protein, 108 aa, Homo sapiens
MKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARL

SEQ ID NO: 48145 - protein, 18 aa, Homo sapiens
MKSCGKRFHDEVGKFRFL

SEQ ID NO: 48146 - protein, 60 aa, Homo sapiens
MKSCGKRFHDEVGKFRFLNELIKVVSPKYLGSRTSEKVKNKILELLYSWTVGLPEEVKIA

SEQ ID NO: 48147 - protein, 28 aa, Homo sapiens
MKSCGKRFHDEVGKFRFLNELIKVVSPK

SEQ ID NO: 48148 - protein, 246 aa, Homo sapiens
MTPGTANRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQ

SEQ ID NO: 48149 - protein, 70 aa, Homo sapiens
MKSCGKRFHDEVGKFRFLNELIKVVSPKYLGSRTSEKVKNKILELLYSWTVGLPEEVKIAEAYQMLKKQG

SEQ ID NO: 48150 - protein, 723 aa, Homo sapiens
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 48151 - protein, 690 aa, Homo sapiens
MAEAEGESLESWLNKATNPSNRQEDWEYIIGFCDQINKELEGPQIAVRLLAHKIQSPQEWEALQALTYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 48152 - protein, 651 aa, Homo sapiens; identical to SEQ ID NO: 48130

SEQ ID NO: 48153 - protein, 153 aa, Homo sapiens
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQAFSQAAEKQKPR

SEQ ID NO: 48154 - protein, 601 aa, Homo sapiens
MALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 48155 - protein, 1498 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGLLEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 48156 - protein, 1498 aa, Homo sapiens; identical to SEQ ID NO: 48155

SEQ ID NO: 48157 - protein, 1390 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGLLEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTVLRPASLPG

SEQ ID NO: 48158 - protein, 1134 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGLLEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDEVRPGHLLWRQRGAGHVSPGHAATRETRRTKLHRVPSVATFGVATF

SEQ ID NO: 48159 - protein, 2230 aa, Homo sapiens
MFKKLKQKISEEQQQLQQALAPAQASSNSSTPTRMRSRTSSFTEQLDEGTPNRESGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNVTIMELQTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMFTSPRSGIF

SEQ ID NO: 48160 - protein, 2243 aa, Homo sapiens
MFKKLKQKISEEQQQLQQALAPAQASSNSSTPTRMRSRTSSFTEQLDEGTPNRENASTHASKSPDSVNGSEPSIPQSGDTQSFAQKLQLRVPSVESLFRSPIKESLFRSSSKESLVRTSSRESLNRLDLDSSTASFDPPSDMDSEAEDLVGNSDSLNKEQLIQRLRRMERSLSSYRGKYSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETNQKEQIESLTEVHRRELNDVISIWEKKLNQQAEELQEIHEIQLQEKEQEVAELKQKILLFGCEKEEMNKEITWLKEEGVKQDTTLNELQEQLKQKSAHVNSLAQDETKLKAHLEKLEVDLNKSLKENTFLQEQLVELKMLAEEDKRKVSELTSKLKTTDEEFQSLKSSHEKSNKSLEDKSLEFKKLSEELAIQLDICCKKTEALLEAKTNELINISSSKTNAILSRISHCQHRTTKVKEALLIKTCTVSELEAQLRQLTEEQNTLNISFQQATHQLEEKENQIKSMKADIESLVTEKEALQKEGGNQQQAASEKESCITQLKKELSENINAVTLMKEELKEKKVEISSLSKQLTDLNVQLQNSISLSEKEAAISSLRKQYDEEKCELLDQVQDLSFKVDTLSKEKISALEQVDDWSNKFSEWKKKAQSRFTQHQNTVKELQIQLELKSKEAYEKDEQINLLKEELDQQNKRFDCLKGEMEDDKSKMEKKESNLETELKSQTARIMELEDHITQKTIEIESLNEVLKNYNQQKDIEHKELVQKLQHFQELGEEKDNRVKEAEEKILTLENQVYSMKAELETKKKELEHVNLSVKSKEEELKALEDRLESESAAKLAELKRKAEQKIAAIKKQLLSQMEEKEEQYKKGTESHLSELNTKLQEREREVHILEEKLKSVESSQSETLIVPRSAKNVAAYTEQEEADSQGCVQKTYEEKISVLQRNLTEKEKLLQRVGQEKEETVSSHFEMRCQYQERLIKLEHAEAKQHEDQSMIGHLQEELEEKNKKYSLIVAQHVEKEGGKNNIQAKQNLENVFDDVQKTLQEKELTCQILEQKIKELDSCLVRQKEVHRVEMEELTSKYEKLQALQQMDGRNKPTELLEENTEEKSKSHLVQPKLLSNMEAQHNDLEFKLAGAEREKQKLGKEIVRLQKDLRMLRKEHQQELEILKKEYDQEREEKIKQEQEDLELKHNSTLKQLMREFNTQLAQKEQELEMTIKETINKAQEVEAELLESHQEETNQLLKKIAEKDDDLKRTAKRYEEILDAREEEMTAKVRDLQTQLEELQKKYQQKLEQEENPGNDNTQLAQKTTLISDSKLKEQEFREQIHNLEDRLKKYEKNVYATTVGTPYKGGNLYHTDVSLFGEPTEFEYLRKVLFEYMMGRETKTMAKVITTVLKFPDDQTQKILEREDARLMSWLRSSS

SEQ ID NO: 48161 - protein, 731 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTFQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 48162 - protein, 691 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTFQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFRLCFTSGS

SEQ ID NO: 48163 - protein, 640 aa, Homo sapiens
MSWFVDLAGKAEDLLNRVDQGAATALSRKDNASNIYSKNTDYTELHQQNTDLIYQTGPKSTYISSAADNIRNQKATIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTFQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 48164 - protein, 167 aa, Homo sapiens
MATEVHNLQELRRSASLATKVFIQRDYSDGTICQFQTKFPPELDSRIERQLFEETVKTLNGFYAEAEKIGGSSYLEGCLACATAYFIFLCMETHYEKVLKKISRYIQEQNEKIFAPRGLLLTDPVERGMRVIEISIYEDRCSSGSSSSGSSSGSGSSSGGGGGAGAR

SEQ ID NO: 48165 - protein, 603 aa, Homo sapiens
MAEETGQSKLAAAKKKFKEYWQRNRPGVPAAAKRNTKANGSSPETAASGGCHSSEASSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQKVHRLLTEPGDSAKDASPGGGHHQAGPGQGGEEGEAAGAAGDGVAACGSYSEGHGKFLAAARNPAAEPSPGAPAPQELGAADKHGDLCEASLTNSVEPAQGEAREGSSQDNPTAQPVLQLLGEMQDHQEHPGLGSNCCVPCFCWAWLPRRRR

SEQ ID NO: 48166 - protein, 494 aa, Homo sapiens
EKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELHENKSALQLEQQVKELQEKLGQVMETLTSAEKEPEAAVPASGTGGESSGLMDLLEEKADLREHVEKLELGFIQYRRERCHQKVHRLLTEPGDSAKDASPGGGHHQAGPGQGGEEGEAAGAAGDGVAACGSYSEGHGKFLAAARNPAAEPSPGAPAPQELGAADKHGDLCEASLTNSVEPAQGEAREGSSQDNPTAQPVLQLLGEMQDHQEHPGLGSNCCVPCFCWAWLPRRRR

SEQ ID NO: 48167 - protein, 603 aa, Homo sapiens; identical to SEQ ID NO: 48165

SEQ ID NO: 48168 - protein, 633 aa, Homo sapiens
MLPVDGEERKSEGSDTEGDRTSPCAGPTSSATLKDLEVGGSGWRCSDPAGQPSNLLPQRGLGAPLPAETAHTQPSPNDRSLYLSPKSSSASSSLHARQSPCQEQAAVLNSRSIKISRLNDTIKSLKQQKKQVEHQLEEEKKANNEKQKAERELEGQIQRLNTEKKKLNTDLYHMKHSLRYFEEESKDLAGRLQRSSQRIGELEWSLCAVAATQKKKPDGFSSRSKALLKRQLEQSIREQILLKGHVTQLKESLKEVQLERDQYAEQIKGERAQWQQRMRKMSQEVCTLKEEKKHDTHRVEELERSLSRLKNQMAEPLPPDAPAVSSEVELQDLRKELERVAGELQAQVENNQCISLLNRGQKERLREQEERLQEQQERLREREKRLQQLAEPQSDLEELKHENKSALQLEQQVKELQEKLGQVMETLTSAEKEPEAAVPASGTGGESSGLMDLLEEKADLREHVEKLELGFIQYRRERCHQKVHRLLTEPGDSAKDASPGGGHHQAGPGQGGEEGEAAGAAGDGVAACGSYSEGHGKFLAAARNPAAEPSPGAPAPQELGAADKHGDLCEASLTNSVEPAQGEAREGSSQDNPTAQPVLQLLGEMQDHQEHPGLGSNCCVPCFCWAWLPRRRR

SEQ ID NO: 48169 - protein, 3259 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEGNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 48170 - protein, 972 aa, Homo sapiens
MKAQGGTVLPTEPQSEEQLSKHDKSSTEEEMEIEKIKHKLQEKEELISTLQAQLTQAQAEQPAQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKP

SEQ ID NO: 48171 - protein, 41 aa, Homo sapiens
MLSRLSGLANVVLHELSGDDDTDQNMRAPLDPELHQESDME

SEQ ID NO: 48172 - protein, 1640 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKE

SEQ ID NO: 48173 - protein, 3269 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQLSSMQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEGNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAVSKEKGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 48174 - protein, 246 aa, Homo sapiens
MSWAAVLAVAAARFGHFWGCRWPGPMAQGWAGFSEEELRRLKQTKDPFEPQRRLPAKKSRQQLQREKALVEQSQKLGLQDGSTSLLPEQLLSAPKQRVNVQKPPFSSPTLPSHFTLTSPVGDGQPQGIESQPKELGLENSHDGHNNVEILPPKPDCKLEKKKVELQEKSRWEVLQQEQRLMEEKNKRKKALLAKAIAERSKRTQAETMKLKRIQKELQALDDMVSADIGILRNRIDQASLDYSYAR

SEQ ID NO: 48175 - protein, 394 aa, Homo sapiens
MSWAAVLAVAAARFGHFWGCRWPGPMAQGWAGFSEEELRRLKQTKDPFEPQRRLPAKKSRQQLQREKALVEQSQKLGLQDGSTSLLPEQLLSAPKQRVNVQKPPFSSPTLPSHFTLTSPVGDGQPQGIESQPKELGLENSHDGHNNVEILPPKPDCKLEKKKVELQEKSRWEVLQQEQRLMEEKNKRKKALLAKAIAERSKRTQAETMKLKRIQKELQALDDMVSADIGILRNRIDQASLDYSYARKRFDRAEAEYIAAKLDIQRKTEIKEQLTEHLCTIIQQNELRKAKKLEELMQQLDVEADEETLELEVEVERLLHEQEVESRRPVVRLERPFQPAEESVTLEFAKENRKCQEQAVSPKVDDQCGNSSSIPFLSPNCPNQEGNDISAALAT

SEQ ID NO: 48176 - protein, 286 aa, Homo sapiens
  MOD_RES (86)..(86): Selenocysteine
MPLDATWNITVQWLAVDIACRTLMFLKLMATYSAAFLPVVIGLDRQAAVLNPLGSRSGVRKLLGAAWGLSFLLAFPQLFLFHTVHCAGPVPFTQCVTKGSFKAQWQETTYNLFTFCCLFLLPLTAMAICYSRIVLSVSRPQTRKGSHAPAGEFALPRSFDNCPRVRLRALRLALLILLTFILCWTPYYLLGMWYWFSPTMLTEVPPSLSHILFLLGLLNAPLDPLLYGAFTLGCRRGHQELSIDSSKEGSGRMLQEEIHAFRQLEVQKTVTSRRAGETKGISITSI

SEQ ID NO: 48177 - protein, 292 aa, Homo sapiens
  MOD_RES (92)..(92): Selenocysteine
MSAGNGTPWDATWNITVQWLAVDIACRTLMFLKLMATYSAAFLPVVIGLDRQAAVLNPLGSRSGVRKLLGAAWGLSFLLAFPQLFLFHTVHCAGPVPFTQCVTKGSFKAQWQETTYNLFTFCCLFLLPLTAMAICYSRIVLSVSRPQTRKGSHAPAGEFALPRSFDNCPRVRLRALRLALLILLTFILCWTPYYLLGMWYWFSPTMLTEVPPSLSHILFLLGLLNAPLDPLLYGAFTLGCRRGHQELSIDSSKEGSGRMLQEEIHAFRQLEVQKTVTSRRAGETKGISITSI

SEQ ID NO: 48178 - protein, 120 aa, Homo sapiens
MASSRRGLLLLLLLTAHLGPSEAQHWSHGWYPGGKRALSSAQDPQNALRPPGRALDTAAGSPVQTAHGLPSDALAPLDDSMPWEGRTTAQWSLHRKRHLARTLLTAAREPRPAPPSSNKV

SEQ ID NO: 48179 - protein, 113 aa, Homo sapiens
MASSRRGLLLLLLLTAHLGPSEAQHWSHGWYPGGKRALSSAQDPQNALRPPAGSPVQTAHGLPSDALAPLDDSMPWEGRTTAQWSLHRKRHLARTLLTAAREPRPAPPSSNKV

SEQ ID NO: 48180 - protein, 112 aa, Homo sapiens
MASSRRGLLLLLLLTAHLGPSEAQHWSHGWYPGGKRALSSAQDPQNALRPPGSPVQTAHGLPSDALAPLDDSMPWEGRTTAQWSLHRKRHLARTLLTAAREPRPAPPSSNKV

SEQ ID NO: 48181 - protein, 112 aa, Homo sapiens; identical to SEQ ID NO: 48180

SEQ ID NO: 48182 - protein, 113 aa, Homo sapiens; identical to SEQ ID NO: 48179

SEQ ID NO: 48183 - protein, 328 aa, Homo sapiens
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLYIFRMIHLADSSGQTKVFSQCVTHCSFSQWWHQAFYNFFTFSCLFIIPLFIMLICNAKIIFTLTRVLHQDPHELQLNQSKNNIPRARLKTLKMTVAFATSFTVCWTPYYVLGIWYWFDPEMLNRLSDPVNHFFFLFAFLNPCFDPLIYGYFSL

SEQ ID NO: 48184 - protein, 249 aa, Homo sapiens
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLPLHHPSFHHADLQCKNHLHPDTGPSSGPPRTTTESVQEQYTKSTAEDSKNDGCICHFIYCLLDSLLCPRNLVLV

SEQ ID NO: 48185 - protein, 684 aa, Homo sapiens
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHYLLGNFRDAVIAHEQRLLIAKEFGDKAAERRAYSNLGNAYIFLGEFETASEYYKKTLLLARQLKDRAVEAQSCYSLGNTYTLLQDYEKAIDYHLKHLAIAQELNDRIGEGRACWSLGNAYTALGNHDQAMHFAEKHLEISREVGDKSGELTARLNLSDLQMVLGLSYSTNNSIMSENTEIDSSLNGVRPKLGRRHSMENMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQGSRLDDQRCAPPPATTKGPTVPDEDFFSLILRSQGKRMDEQRVLLQRDQNRDTDFGLKDFLQNNALLEFKNSGKKSADH

SEQ ID NO: 48186 - protein, 684 aa, Homo sapiens; identical to SEQ ID NO: 48185

SEQ ID NO: 48187 - protein, 75 aa, Homo sapiens
MEENLISMREDHSFHVRYRMEASCLELALEGERLCKSGDCRAGVSFFEAAVQVGTEDLKTLSAIYSQLGNAYFYL

SEQ ID NO: 48188 - protein, 213 aa, Homo sapiens
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHY

SEQ ID NO: 48189 - protein, 52 aa, Homo sapiens
MEENLISMREDHSFHVRYRMEASCLELALEGERLCKSGDCRAGVSFFEAAVQ

SEQ ID NO: 48190 - protein, 429 aa, Homo sapiens
MASLWESPQQCIILSPLSGWWFSIGISILTSSALVLKPQMLKGELQTRPSQRPSRKAFRRNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVLPIASEELEGEGSVLKRGPYGTEDDFAVPPSTKLARIEEPKRVLLYVRKESEEVFDALMLKTPSLKGLMEAISDKYDVPHDKIGKIFKKCKKGILVNMDDNIVKHYSNEDTFQLQIEEAGGSYKLTLTEI

SEQ ID NO: 48191 - protein, 618 aa, Homo sapiens
MTQEYDNKRPVLVLQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEVFFPSDLSLRMPGMNSEDYVFDSVSGNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVLPIASEELEGEGSVLKRGPYGTEDDFAVPPSTKLARIEEPKRVLLYVRKESEEVFDALMLKTPSLKGLMEAISDKYDVPHDKIGKIFKKCKKGILVNMDDNIVKHYSNEDTFQLQIEEAGGSYKLTLTEI

SEQ ID NO: 48192 - protein, 618 aa, Homo sapiens
LPKEVENKRPVLVLQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEVFFPSDLSLRMPGMNSEDYVFDSVSGNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVLPIASEELEGEGSVLKRGPYGTEDDFAVPPSTKLARIEEPKRVLLYVRKESEEVFDALMLKTPSLKGLMEAISDKYDVPHDKIGKIFKKCKKGILVNMDDNIVKHYSNEDTFQLQIEEAGGSYKLTLTEI

SEQ ID NO: 48193 - protein, 625 aa, Homo sapiens
MSQESDNNKRLVALVPMPSDPPFNTRRAYTSEDEAWKSYLENPLTAATKAMMSINGDEDSAAALGLLYDYYKVPRDKRLLSVSKASDSQEDQEKRNCLGTSEAQSNLSGGENRVQVLKTVPVNLSLNQDHLENSKREQYSISFPESSAIIPVSGITVVKAEDFTPVFMAPPVHYPRGDGEEQRVVIFEQTQYDVPSLATHSAYLKDDQRSTPDSTYSESFKDAATEKFRSASVGAEEYMYDQTSSGTFQYTLEATKSLRQKQGEGPMTYLNKGQFYAITLSETGDNKCFRHPISKVRSVVMVVFSEDKNRDEQLKYWKYWHSRQHTAKQRVLDIADYKESFNTIGNIEEIAYNAVSFTWDVNEEAKIFITVNCLSTDFSSQKGVKGLPLMIQIDTYSYNNRSNKPIHRAYCQIKVFCDKGAERKIRDEERKQNRKKGKGQASQTQCNSSSDGKLAAIPLQKKSDITYFKTMPDLHSQPVLFIPDVHFANLQRTGQVYYNTDDEREGGSVLVKRMFRPMEEEFGPVPSKQMKEEGTKRVLLYVRKETDDVFDALMLKSPTVKGLMEAISEKYGLPVEKIAKLYKKSKKGILVNMDDNIIEHYSNEDTFILNMESMVEGFKVTLMEI

SEQ ID NO: 48194 - protein, 609 aa, Homo sapiens
MPSDPPFNTRRAYTSEDEAWKSYLENPLTAATKAMMSINGDEDSAAALGLLYDYYKVPRDKRLLSVSKASDSQEDQEKRNCLGTSEAQSNLSGGENRVQVLKTVPVNLSLNQDHLENSKREQYSISFPESSAIIPVSGITVVKAEDFTPVFMAPPVHYPRGDGEEQRVVIFEQTQYDVPSLATHSAYLKDDQRSTPDSTYSESFKDAATEKFRSASVGAEEYMYDQTSSGTFQYTLEATKSLRQKQGEGPMTYLNKGQFYAITLSETGDNKCFRHPISKVRSVVMVVFSEDKNRDEQLKYWKYWHSRQHTAKQRVLDIADYKESFNTIGNIEEIAYNAVSFTWDVNEEAKIFITVNCLSTDFSSQKGVKGLPLMIQIDTYSYNNRSNKPIHRAYCQIKVFCDKGAERKIRDEERKQNRKKGKGQASQTQCNSSSDGKLAAIPLQKKSDITYFKTMPDLHSQPVLFIPDVHFANLQRTGQVYYNTDDEREGGSVLVKRMFRPMEEEFGPVPSKQMKEEGTKRVLLYVRKETDDVFDALMLKSPTVKGLMEAISEKYGLPVEKIAKLYKKSKKGILVNMDDNIIEHYSNEDTFILNMESMVEGFKVTLMEI

SEQ ID NO: 48195 - protein, 625 aa, Homo sapiens
MGKDGRSNKRLVALVPMPSDPPFNTRRAYTSEDEAWKSYLENPLTAATKAMMSINGDEDSAAALGLLYDYYKVPRDKRLLSVSKASDSQEDQEKRNCLGTSEAQSNLSGGENRVQVLKTVPVNLSLNQDHLENSKREQYSISFPESSAIIPVSGITVVKAEDFTPVFMAPPVHYPRGDGEEQRVVIFEQTQYDVPSLATHSAYLKDDQRSTPDSTYSESFKDAATEKFRSASVGAEEYMYDQTSSGTFQYTLEATKSLRQKQGEGPMTYLNKGQFYAITLSETGDNKCFRHPISKVRSVVMVVFSEDKNRDEQLKYWKYWHSRQHTAKQRVLDIADYKESFNTIGNIEEIAYNAVSFTWDVNEEAKIFITVNCLSTDFSSQKGVKGLPLMIQIDTYSYNNRSNKPIHRAYCQIKVFCDKGAERKIRDEERKQNRKKGKGQASQTQCNSSSDGKLAAIPLQKKSDITYFKTMPDLHSQPVLFIPDVHFANLQRTGQVYYNTDDEREGGSVLVKRMFRPMEEEFGPVPSKQMKEEGTKRVLLYVRKETDDVFDALMLKSPTVKGLMEAISEKYGLPVEKIAKLYKKSKKGILVNMDDNIIEHYSNEDTFILNMESMVEGFKVTLMEI

SEQ ID NO: 48196 - protein, 6 aa, Homo sapiens
MSQESD

SEQ ID NO: 48197 - protein, 578 aa, Homo sapiens
MLRRLDKIRFRGHKRDDFLDLAESPNASDTECSDEIPLKVPRTSPRDSEELRDPAGPGTLIMATGVQDFNRTEFDRLNEIKGHLEIALLEKHFLQEELRKLREETNAEMLRQELDRERQRRMELEQKVQEVLKARTEEQMAQQPPKGQAQASNGAERRSQGLSSRLQKWFYERFGEYVEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVGLYAGIKFFLIDFIFKRCPRLRAKYDTPYIIWRSLPTDPQLKERSSAAVSRRLQTTSSRSYVPSAPAGLGKEEDAGRFHSTKKGNFHEIFNLTENERPLAVCENGWRCCLINRDRKMPTDYIRNGVLYVTENYLCFESSKSGSSKRNKVIKLVDITDIQKYKVLSVLPGSGMGIAVSTPSTQKPLVFGAMVHRDEAFETILSQYIKITSAAASGGDS

SEQ ID NO: 48198 - protein, 578 aa, Homo sapiens; identical to SEQ ID NO: 48197

SEQ ID NO: 48199 - protein, 33 aa, Homo sapiens
MLRRLDKIRFRGHKRDDFLDLAESPNASDTECS

SEQ ID NO: 48200 - protein, 593 aa, Homo sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 48201 - protein, 438 aa, Homo sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCRDNRQGWACCPYRQGVCCADRRHCCPAGFRCAARGTKCLRREAPRWDAPLRDPALRQLL

SEQ ID NO: 48202 - protein, 413 aa, Homo sapiens
MAITAAHGASTAVQTGDPASKDQVTTPWVPSSALIVSSNARTSPRAVLWSMAPGGAAPCPRLPAVKTGCTAVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 48203 - protein, 262 aa, Homo sapiens
MRNSYRFLASSLSVVVSLLLIPEDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLMEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 48204 - protein, 247 aa, Homo sapiens
MQPILLLLAFLLLPRADAGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 48205 - protein, 152 aa, Homo sapiens
MQPILLLLAFLLLPRADQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 48206 - protein, 202 aa, Homo sapiens
MQPILLLLAFLLLPRADAGEIIGGHEAKPHSRPYMAYLMIWDQKSLKRCGGFLIRDDFVLTAAHCWGRLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 48207 - protein, 281 aa, Homo sapiens
MKSLSLLHLFPLPRAKREQGGNNSSSNQGSLPEKMQPILLLLAFLLLPRADAGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 48208 - protein, 235 aa, Homo sapiens
MQTFPSGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 48209 - protein, 160 aa, Homo sapiens
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQGDSGGPLVCKDVAQGILSYGNKKGTPPGVYIKVSHFLPWIKRTMKRL

SEQ ID NO: 48210 - protein, 246 aa, Homo sapiens
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQLERKAKWTTAVRPLRLPSSKAQVKPGQLCSVAGWGYVSMSTLATTLQEVLLTVQKDCQCERLFHGNYSRATEICVGDPKKTQTGFKGDSGGPLVCKDVAQGILSYGNKKGTPPGVYIKVSHFLPWIKRTMKRL

SEQ ID NO: 48211 - protein, 115 aa, Homo sapiens
MQPFLLLLAFLLTPGAGTEEIIGGHEAKPHSRPYMAFVQFLQEKSRKRCGGILVRKDFVLTAAHCQGRGDSGGPLVCKDVAQGILSYGNKKGTPPGVYIKVSHFLPWIKRTMKRL

SEQ ID NO: 48212 - protein, 257 aa, Homo sapiens
MEACVSSLLVLALGALSVGSSFGTQIIGGREVIPHSRPYMASLQRNGSHLCGGVLVHPKWVLTAAHCLAQRMAQLRLVLGLHTLDSPGLTFHIKAAIQHPRYKPVPALENDLALLQLDGKVKPSRTIRPLALPSKRQVVAAGTRCSMAGWGLTHQGGRLSRVLRELDLQVLDTRMCNNSRFWNGSLSPSMVCLAADSKDQAPCKGDSGGPLVCGKGRVLARVLSFSSRVCTDIFKPPVATAVAPYVSWIRKVTGRSA

SEQ ID NO: 48213 - protein, 1035 aa, Homo sapiens
MAAETLNFGPEWLRALSGGGSVASPPPSPAMPKYKLADYRYGREEMLALYVKENKVPEELQDKEFAAVLQDEPLQPLALEPLTEEEQRNFSLSVNSVAVLRLMGKGAGPPLAGTSRGRGSTRSRGRGRGDSCFYQRSIEEGDGAFGRSPREIQRSQSWDDRGERRFEKSARRDGARCGFEEGGAGPRKEHARSDSENWRSLREEQEEEEEGSWRLGAGPRRDGDRWRSASPDGGPRSAGWREHGERRRKFEFDLRGDRGGCGEEEGRGGGGSSHLRRCRAPEGFEEDKDGLPEWCLDDEDEEMGTFDASGAFLPLKKGPKEPIPEEQELDFQGLEEEEEPSEGLEEEGPEAGGKELTPLPPQEEKSSSPSPLPTLGPLWGTNGDGDETAEKEPPAAEDDIRGIQLSPGVGSSAGPPGDLEDDEGLKHLQQEAEKLVASLQDSSLEEEQFTAAMQTQGLRHSAAATALPLSHGAARKWFYKDPQGEIQGPFTTQEMAEWFQAGYFSMSLLVKRGCDEGFQPLGEVIKMWGRVPFAPGPSPPPLLGNMDQERLKKQQELAAAALYQQLQHQQFLQLVSSRQLPQCALREKAALGDLTPPPPPPPQQQQQQLTAFLQQLQALKPPRGGDQNLLPTMSRSLSVPDSGRLWDVHTSASSQSGGEASLWDIPINSSTQGPILEQLQLQHKFQERREVELRAKREEEERKRREEKRRQQQQEEQKRRQEEEELFRRKHVRQQELLLKLLQQQQAVPVPPAPSSPPPLWAGLAKQGLSMKTLLELQLEGERQLHKQPPPREPARAQAPNHRVQLGGLGTAPLNQWVSEAGPLWGGPDKSGGGSSGLGLWEDTPKSGGSLVRGLGLKNSRSSPSLSDSYSHLSGRPIRKKTEEEEKLLKLLQGIPRPQDGFTQWCEQMLHTLSATGSLDVPMAVAILKEVESPYDVHDYIRSCLGDTLEAKEFAKQFLERRAKQKASQQRQQQQEAWLSSASLQTAFQANHSTKLGPGEGSKAKRRALMLHSDPSILGYSLHGSSGEIESVDDY

SEQ ID NO: 48214 - protein, 754 aa, Homo sapiens
SSFPSPRLPQVFHRLDDEDEEMGTFDASGAFLPLKKGPKEPIPEEQELDFQGLEEEEEPSEGLEEEGPEAGGKELTPLPPQEEKSSSPSPLPTLGPLWGTNGDGDETAEKEPPAAEDDIRGIQLSPGVGSSAGPPGDLEDDEGLKHLQQEAEKLVASLQDSSLEEEQFTAAMQTQGLRHSAAATALPLSHGAARKWFYKDPQGEIQGPFTTQEMAEWFQAGYFSMSLLVKRGCDEGFQPLGEVIKMWGRVPFAPGPSPPPLLGNMDQERLKKQQELAAAALYQQLQHQQFLQLVSSRQLPQCALREKAALGDLTPPPPPPPQQQQQQLTAFLQQLQALKPPRGGDQNLLPTMSRSLSVPDSGRLWDVHTSASSQSGGEASLWDIPINSSTQGPILEQLQLQHKFQERREVELRAKREEEERKRREEKRRQQQQEEQKRRQEEEELFRRKHVRQQELLLKLLQQQQAVPVPPAPSSPPPLWAGLAKQGLSMKTLLELQLEGERQLHKQPPPREPARAQAPNHRVQLGGLGTAPLNQWVSEAGPLWGGPDKSGGGSSGLGLWEDTPKSGGSLVRGLGLKNSRSSPSLSDSYSHLSGRPIRKKTEEEEKLLKLLQGIPRPQDGFTQWCEQMLHTLSATGSLDVPMAVAILKEVESPYDVHDYIRSCLGDTLEAKEFAKQFLERRAKQKASQQRQQQQEAWLSSASLQTAFQANHSTKLGPGEGSKAKRRALMLHSDPSILGYSLHGSSGEIESVDDY

SEQ ID NO: 48215 - protein, 1299 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 48216 - protein, 1321 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGKKNGYYCMYSPVLLLGQPLCQGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 48217 - protein, 1321 aa, Homo sapiens; identical to SEQ ID NO: 48216

SEQ ID NO: 48218 - protein, 1299 aa, Homo sapiens; identical to SEQ ID NO: 48215

SEQ ID NO: 48219 - protein, 720 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRPNFEEGGPTSVGRKHEFIRSESENWRIFREEQNGEDEDGGWRLAGSRRDGERWRPHSPGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEER

SEQ ID NO: 48220 - protein, 93 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFS

SEQ ID NO: 48221 - protein, 100 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAA

SEQ ID NO: 48222 - protein, 13 aa, Homo sapiens
MAAETQTLNFGPE

SEQ ID NO: 48223 - protein, 115 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVG

SEQ ID NO: 48224 - protein, 106 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTG

SEQ ID NO: 48225 - protein, 113 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTV

SEQ ID NO: 48226 - protein, 872 aa, Homo sapiens
MTKLPDDPGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEESSASFCFYATAKAPAEGVDESSSAAAATATAETLRLGECQQTFRYHEISSGDPAGRGQANAKAAAAAAATPATKQSS

SEQ ID NO: 48227 - protein, 787 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREVGKRDS

SEQ ID NO: 48228 - protein, 1293 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGRPNFEEGGPTSVGRKHEFIRSESENWRIFREEQNGEDEDGGWRLAGSRRDGERWRPHSPGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVEASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 48229 - protein, 1320 aa, Homo sapiens
MAAETQTLNFGPEWLRALSSGGSITSPPLSPALPKYKLADYRYGREEMLALFLKDNKIPSDLLDKEFLPILQEEPLPPLALVPFTEEEQRNFSMSVNSAAVLRLTGRGGGGTVVGAPRGRSSSRGRGRGRGECGFYQRSFDEVEGVFGRGGGREMHRSQSWEERGDRRFEKPGRKDVGKKNGYYCMYSPVLLLGQPLCQGRPNFEEGGPTSVGRKHEFIRSESENWRIFREEQNGEDEDGGWRLAGSRRDGERWRPHSPDGPRSAGWREHMERRRRFEFDFRDRDDERGYRRVRSGSGSIDDDRDSLPEWCLEDAEEEMGTFDSSGAFLSLKKVQKEPIPEEQEMDFRPVDEGEECSDSEGSHNEEAKEPDKTNKKEGEKTDRVGVASEETPQTSSSSARPGTPSDHQSQEASQFERKDEPKTEQTEKAEEETRMENSLPAKVPSRGDEMVADVQQPLSQIPSDTASPLLILPPPVPNPSPTLRPVETPVVGAPGMGSVSTEPDDEEGLKHLEQQAEKMVAYLQDSALDDERLASKLQEHRAKGVSIPLMHEAMQKWYYKDPQGEIQGPFNNQEMAEWFQAGYFTMSLLVKRACDESFQPLGDIMKMWGRVPFSPGPAPPPHMGELDQERLTRQQELTALYQMQHLQYQQFLIQQQYAQVLAQQQKAALSSQQQQQLALLLQQFQTLKMRISDQNIIPSVTRSVSVPDTGSIWELQPTASQPTVWEGGSVWDLPLDTTTPGPALEQLQQLEKAKAAKLEQERREAEMRAKREEEERKRQEELRRQQEEILRRQQEEERKRREEEELARRKQEEALRRQREQEIALRRQREEEERQQQEEALRRLEERRREEEERRKQEELLRKQEEEAAKWAREEEEAQRRLEENRLRMEEEAARLRHEEEERKRKELEVQRQKELMRQRQQQQEALRRLQQQQQQQQLAQMKLPSSSTWGQQSNTTACQSQATLSLAEIQKLEEERERQLREEQRRQQRELMKALQQQQQQQQQKLSGWGNVSKPSGTTKSLLEIQQEEARQMQKQQQQQQQHQQPNRARNNTHSNLHTSIGNSVWGSINTGPPNQWASDLVSSIWSNADTKNSNMGFWDDAVKEVGPRNSTNKNKNNASLSKSVGVSNRQNKKVEEEEKLLKLFQGVNKAQDGFTQWCEQMLHALNTANNLDVPTFVSFLKEVESPYEVHDYIRAYLGDTSEAKEFAKQFLERRAKQKANQQRQQQQLPQQQQQQPPQQPPQQPQQQDSVWGMNHSTLHSVFQTNQSNNQQSNFEAVQSGKKKKKQKMVRADPSLLGFSVNASSERLNMGEIETLDDY

SEQ ID NO: 48230 - protein, 694 aa, Homo sapiens
MSGGEVVCSGWLRKSPPEKKLKRYAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKVKPAPLEIKPLPEWEELQAPVRSPITRSFARDSSRFPMSPRPDSVHSTTSSSDSHDSEENYVPMNPNLSSEDPNLFGSNSLDGGSSPMIKPKGDKQVEYLDLDLDSGKSTPPRKQKSSGSGSSVADERVDYVVVDQQKTLALKSTREAWTDGRQSTESETPAKSVK

SEQ ID NO: 48231 - protein, 724 aa, Homo sapiens
MSGGEVVCSGWLRKSPPEKKLKRYAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKGQSPKILRLKPHGLERTDSQTIGDFATRRKVKPAPLEIKPLPEWEELQAPVRSPITRSFARDSSRFPMSPRPDSVHSTTSSSDSHDSEENYVPMNPNLSSEDPNLFGSNSLDGGSSPMIKPKGDKQVEYLDLDLDSGKSTPPRKQKSSGSGSSVADERVDYVVVDQQKTLALKSTREAWTDGRQSTESETPAKSVK

SEQ ID NO: 48232 - protein, 591 aa, Homo sapiens
MNKWVRCICDICGFNPTEEDPVKPPGSSLQAPADLPLAINTAPPSTQADSSSATLPPPYQLINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKVKPAPLEIKPLPEWEELQAPVRSPITRSFARDSSRFPMSPRPDSVHSTTSSSDSHDSEENYVPMNPNLSSEDPNLFGSNSLDGGSSPMIKPKGDKQVEYLDLDLDSGKSTPPRKQKSSGSGSSVADERVDYVVVDQQKTLALKSTREAWTDGRQSTESETPAKSVK

SEQ ID NO: 48233 - protein, 638 aa, Homo sapiens
MSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPSRHNTEFRDSTYDLPRSLASHGHTKGSLTGSETDNEDVYTFKTPSNTLCREFGDLLVDNMDVPATPLSAYQIPRTFTLDKNHNAMTVATPGDSAIAPPPRPPKPSQAETPRWGSPQQRPPISENSRSVAATIPRRNTLPAMDNSRLHRASSCETYEYPQRGGESAGRSAESMSDGVGSFLPGKMIVGRSDSTNSEDNYVPMNPGSSTLLAMERAGDNSQSVYIPMSPGAHHFDSLGYPSTTLPVHRGPSRGSEIQPPPVNRNLKPDRKAKPTPLDLRNNTVIDELPFKSPITKSWSRANHTFNSSSSQYCRPISTQSITSTDSGDSEENYVPMQNPVSASPVPSGTNSPAPKKSTGSVDYLALDFQPSSPSPHRKPSTSSVTSDEKVDYVQVDKEKTQALQNTMQEWTDVRQSSEPSKGAKL

SEQ ID NO: 48234 - protein, 676 aa, Homo sapiens
MSGGGDVVCTGWLRKSPPEKKLRRYAWKKRWFILRSGRMSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPSRHNTEFRDSTYDLPRSLASHGHTKGSLTGSETDNEDVYTFKTPSNTLCREFGDLLVDNMDVPATPLSAYQIPRTFTLDKNHNAMTVATPGDSAIAPPPRPPKPSQAETPRWGSPQQRPPISENSRSVAATIPRRNTLPAMDNSRLHRASSCETYEYPQRGGESAGRSAESMSDGVGSFLPGKMIVGRSDSTNSEDNYVPMNPGSSTLLAMERAGDNSQSVYIPMSPGAHHFDSLGYPSTTLPVHRGPSRGSEIQPPPVNRNLKPDRKAKPTPLDLRNNTVIDELPFKSPITKSWSRANHTFNSSSSQYCRPISTQSITSTDSGDSEENYVPMQNPVSASPVPSGTNSPAPKKSTGSVDYLALDFQPSSPSPHRKPSTSSVTSDEKVDYVQVDKEKTQALQNTMQEWTDVRQSSEPSKGAKL

SEQ ID NO: 48235 - protein, 131 aa, Homo sapiens
MSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTL

SEQ ID NO: 48236 - protein, 102 aa, Homo sapiens
MSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRS

SEQ ID NO: 48237 - protein, 330 aa, Homo sapiens
MEAVAKFDFTASGEDELSFHTGDVLKILSNQEEWFKAELGSQEGYVPKNFIDIQFPKWFHEGLSRHQAENLLMGKEVGFFIIRASQSSPGDFSISVRHEDDVQHFKVMRDNKGNYFLWTEKFPSLNKLVDYYRTNSISRQKQIFLRDRTREDQGHRGNSLDRRSQGGPHLSGAVGEEIRPSMNRKLSDHPPTLPLQQHQHQPQPPQYAPAPQQLQQPPQQRYLQHHHFHQERRGGSLDINDGHCGTGLGSEMNAALMHRRHTDPVQLQAAGRVRWARALYDFEALEDDELGFHSGEVVEVLDSSNPSWWTGRLHNKLGLFPANYVAPMTR

SEQ ID NO: 48238 - protein, 217 aa, Homo sapiens
MVSRRPLSTPGRELTHGQGGWLLHHPGQPELPRGLLHLCQGHRGNSLDRRSQGGPHLSGAVGEEIRPSMNRKLSDHPPTLPLQQHQHQPQPPQYAPAPQQLQQPPQQRYLQHHHFHQERRGGSLDINDGHCGTGLGSEMNAALMHRRHTDPVQLQAAGRVRWARALYDFEALEDDELGFHSGEVVEVLDSSNPSWWTGRLHNKLGLFPANYVAPMTR

SEQ ID NO: 48239 - protein, 330 aa, Homo sapiens; identical to SEQ ID NO: 48237

SEQ ID NO: 48240 - protein, 97 aa, Homo sapiens
MEAVAKFDFTASGEDELSFHTGDVLKILSNQEEWFKAELGSQEGYVPKNFIDIQFPKWFHEGLSRHQAENLLMGKEVGFFIIRASQSSPGDFSISVR

SEQ ID NO: 48241 - protein, 264 aa, Homo sapiens
MLEFVSLLARKDSNNSVSKPRHKLNPFSSKRHEDDVQHFKVMRDNKGNYFLWTEKFPSLNKLVDYYRTNSISRQKQIFLRDRTREDQGHRGNSLDRRSQGGPHLSGAVGEEIRPSMNRKLSDHPPTLPLQQHQHQPQPPQYAPAPQQLQQPPQQRYLQHHHFHQERRGGSLDINDGHCGTGLGSEMNAALMHRRHTDPVQLQAAGRVRWARALYDFEALEDDELGFHSGEVVEVLDSSNPSWWTGRLHNKLGLFPANYVAPMTR

SEQ ID NO: 48242 - protein, 278 aa, Homo sapiens
MEAVAKFDFTASGEDELSFHTGDVLKILSNQEEWFKAELGSQEGYVPKNFIDIQFPKHEDDVQHFKVMRDNKGNYFLWTEKFPSLNKLVDYYRTNSISRQKQIFLRDRTREDQGHRGNSLDRRSQGGPHLSGAVGEEIRPSMNRKLSDHPPTLPLQQHQHQPQPPQYAPAPQQLQQPPQQRYLQHHHFHQERRGGSLDINDGHCGTGLGSEMNAALMHRRHTDPVQLQAAGRVRWARALYDFEALEEVLDSSNPSWWTGRLHNKLGLFPANYVAPMTR

SEQ ID NO: 48243 - protein, 304 aa, Homo sapiens
MLEFVSLLARKDSNNSVSKPRHKLNPFSSKRWFHEGLSRHQAENLLMGKEVGFFIIRASQSSPGDFSISVRHEDDVQHFKVMRDNKGNYFLWTEKFPSLNKLVDYYRTNSISRQKQIFLRDRTREDQGHRGNSLDRRSQGGPHLSGAVGEEIRPSMNRKLSDHPPTLPLQQHQHQPQPPQYAPAPQQLQQPPQQRYLQHHHFHQERRGGSLDINDGHCGTGLGSEMNAALMHRRHTDPVQLQAAGRVRWARALYDFEALEDDELGFHSGEVVEVLDSSNPSWWTGRLHNKLGLFPANYVAPMTR

SEQ ID NO: 48244 - protein, 258 aa, Homo sapiens
MGKEVGFFIIRASQSSPGDFSISVRHEDDVQHFKVMRDNKGNYFLWTEKFPSLNKLVDYYRTNSISRQKQIFLRDRTREDQGHRGNSLDRRSQGGPHLSGAVGEEIRPSMNRKLSDHPPTLPLQQHQHQPQPPQYAPAPQQLQQPPQQRYLQHHHFHQERRGGSLDINDGHCGTGLGSEMNAALMHRRHTDPVQLQAAGRVRWARALYDFEALEDDELGFHSGEVVEVLDSSNPSWWTGRLHNKLGLFPANYVAPMTR

SEQ ID NO: 48245 - protein, 168 aa, Homo sapiens
MFWKLSLSLFLVAVLVKVAEARKNRPAGAIPSPYKDGSSNNSERWQHQIKEVLASSQEALVVTERKYLKSDWCKTQPLRQTVSEEGCRSRTILNRFCYGQCNSFYIPRHVKKEEESFQSCAFCKPQRVTSVLVELECPGLDPPFRLKKIQKVKQCRCMSVNLSDSDKQ

SEQ ID NO: 48246 - protein, 480 aa, Homo sapiens
MAGTRWVLGALLRGCGCNCSSCRRTGAACLPFYSAAGSIPSGVSGRRRLLLLLGAAAAAASQTRGLQTGPVPPGRLAGPPAVATSAAAAAAASYSALRASLLPQSLAAAAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 48247 - protein, 318 aa, Homo sapiens
MEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 48248 - protein, 453 aa, Homo sapiens
AAAVPTRSYSQVRGRREGPGARSLPGRVHAPPRPSVPPCAPRGHARGSATLAAHPPPSTLCSYWALEQGKLSQASGLLLVLFSPRVSGRLGSESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 48249 - protein, 318 aa, Homo sapiens; identical to SEQ ID NO: 48247

SEQ ID NO: 48250 - protein, 417 aa, Homo sapiens
  MOD_RES (1)..(1): Any amino acid
XPPPSTLCSYWALEQGKLSQASGLLLVLFSPRVSGRLGSVSVAGVNVEALFPAWPMESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 48251 - protein, 412 aa, Homo sapiens
MAGTRWVLGALLRGCGCNCSSCRRTGAACLPFYSAAGSIPAAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 48252 - protein, 362 aa, Homo sapiens
MESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 48253 - protein, 466 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPSQTGRTREIVMPSRNYTPYTRVLELTMKKTLT

SEQ ID NO: 48254 - protein, 397 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPSQTGRTREIVMPSRNYTPYTRVLELTMKKTLT

SEQ ID NO: 48255 - protein, 415 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEENNELQSRLDYLTETQAKTEVETREIGVGCDLLPRQSRKFEKVLNEFVQLLPLPHHLLWAFGNVCWRRHFGLLQ

SEQ ID NO: 48256 - protein, 438 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEENNELQSRLDYLTETQAKTEVETREIGVGCDLLPSQTGRTREIVMPSRNYTPYTRVLELTMKKTLT

SEQ ID NO: 48257 - protein, 445 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPRRCKQSSQRKN

SEQ ID NO: 48258 - protein, 550 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPRLPFRQNDSSSHCQKSGSPISSEERRRRDKQHLDDITAARLLPLHHMPTQLLSIEESLALQKQQKQNYEEMQAKLAAQKLAERLNIKMRSYNPEGESSGRYREVRDEDDDWSSDEF

SEQ ID NO: 48259 - protein, 435 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKAIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPSQTGRTREIVMPSRNYTPYTRVLELTMKKTLT

SEQ ID NO: 48260 - protein, 466 aa, Homo sapiens; identical to SEQ ID NO: 48253

SEQ ID NO: 48261 - protein, 438 aa, Homo sapiens; identical to SEQ ID NO: 48256

SEQ ID NO: 48262 - protein, 466 aa, Homo sapiens; identical to SEQ ID NO: 48253

SEQ ID NO: 48263 - protein, 775 aa, Homo sapiens
MEKFGMNFGGGPSKKDLLETIETQKKQLLQYQARLKDVVRAYKSLLKEKEALEASIKVLSVSHEADVGLAGVQLPGLTFPDSVDDRCSTHSEDSTGTATSLDTAASLTSTKGEFGVEDDRPARGPPPPKSEEASWSESGVSSSSGDGPFAGGEVDKRLHQLKTQLATLTSSLATVTQEKSRMEASYLADKKKMKQDLEDASNKAEEERARLEGELKGLQEQIAETKARLITQQHDRAQEQSDHALMLRELQKLLQEERTQRQDLELRLEETREALAGRAYAAEQMEGFELQTKQLTREVEELKSELQAIRDEKNQPDPRLQELQEEAARLKSHFQAQLQQEMRKTALAEDQLRQQSQVEEQRVAALENQISEVSELLGTYEKAKQKDQLAIQKLKERILQLDLENKTLALAASSRSPLDSHGEESSLDVNVLKDKMEKLKRLLQVAARKSQVTLDVEKLCDLEIMPSSEAADGEKATALYYQQELKQLKEEFERYKMRAQVVLKSKNTKDGNLGKELEAAQEQLAELKEKYISLRLSCEELEHQHQQEADDWKQELARLQQLHRQELERCQLDFRDRTLKLEEELHKQRDRALAVLTEKDLELEQLRSVALASGLPGRRSPVGGGGPGDPADTSSSDSLTQALQLAAANEPTFFLYAEQLARKEVEITSLRKQKHRLEVEVHQLQDRLLEEGERHREEVAALQSHIEKNIRDQSREGANLEYLKNIIYRFLTLPDSLGRQQTLTAILTILHFSPEEKQVIMRLPTSASWWPSGKR

SEQ ID NO: 48264 - protein, 1684 aa, Homo sapiens
MEDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIENLEKECKEKEEKINKIKLVAVKAKKELDSSRKETQTVKEELESLRSEKDQLSASMRDLIQGAESYKNLLLEYEKQSEQLDVEKERANNFEHRIEDLTRQLRNSTLQCETINSDNEDLLARIETLQSNAKLLEVQILEVQRAKAMVDKELEAEKLQKEQKIKEHATTVNELEELQVQLQKQKKQLQKTMQELELVKKDAQQTTLMNMEIADYERLMKELNQKLTNKNNKIEDLEQEIKIQKQKQETLQEEITSLQSSVQQYEEKNTKIKQLLVKTKKELADSKQAETDHLILQASLKGELEASQQQVEVYKIQLAEITSEKHKIHEHLKTSAEQHQRTLSAYQQRVTALQEECRAAKAEQATVTSEFESYKVRVHNVLKQQKNKSMSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLR

SEQ ID NO: 48265 - protein, 683 aa, Homo sapiens
MCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEETINSVQKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSKK

SEQ ID NO: 48266 - protein, 448 aa, Homo sapiens
MEDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDS

SEQ ID NO: 48267 - protein, 625 aa, Homo sapiens
MAQALSEEEFQRMQAQLLELRTNNYQLSDELRKNGVELTSLRQKVAYLDKEFSKAQKALSKSKKAQEVEVLLSENEMLQAKLHSQEEDFRLQNSTLMAEFSKERYGKEAGKFSAVSEGQGDPPGGPAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQVSIQSADAQEQVEGLLAENNALRTSLAALEQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARVRGKEEPTAPASLNPKI

SEQ ID NO: 48268 - protein, 810 aa, Homo sapiens [sequence omitted]

SEQ ID NO: 48269 - protein, 841 aa, Homo sapiens
MAQALSEEEFQRMQAQLLELRTNNYQLSDELRKNGVELTSLRQKVAYLDKEFSKAQKALSKSKKAQEVEVLLSENEMLQAKLHSQEEDFRLQNSTLMAEFSKLCSQMEQLEQENQQLKEGAAGAGVAQAGPLVDGELLRLQAENTALQKNVAALQERYGKEAGKFSAVSEGQGDPPGGPAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQVSIQSADAQEQVEGLLAENNALRTSLAALEQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEESLQQQQQEQEEALKQCREQHAAELKGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKWMLEEKVKHLEVSSASMAEDLCRKSAIIETYVMDSRIDVSVAAGHTDRSGLGSVLRDLVKPGDENLREMNKKLQNMLEEQLTKNMHLHKDMEVLSQEIVRLSKECVGPPDPDLEPGETS

SEQ ID NO: 48270 - protein, 796 aa, Homo sapiens [sequence omitted]

SEQ ID NO: 48271 - protein, 810 aa, Homo sapiens
MAQALSEEEFQRMQAQLLELRTNNYQLSDELRKNGVELTSLRQKVAYLDKEFSKAQKSPGPCLPLQEVEVLLSENEMLQAKLHSQEEDFRLQNSTLMAEFSKLCSQMEQLEQENQQLKEGAAGAGVAQAGPLVDGELLRLQAENTALQKNVAALQERYGKEAGKFSAVSEGQGDPPGGPAPTVLAPMPLAEVELKWEMEKEEKRLLWEQLQGLESSKQAETSRLQEELAKLSEKLKKKQESFCRLQTEKETLFNDSRNKIEELQQRKEADHKAQLARTQKLQQELEAANQSLAELRDQRQGERLEHAAALRALQDQIQTAKTQELNMLREQTTGLAAELQQQQAEYEDLMGQKDDLNSQLQESLRANSRLLEQLQEIGQEKEQLTQELQEARKSAEKRKAMLDELAMETLQEKSQHKEELGAVRLRHEKEVLGVRARYERELRELHEDKKRQEEELRGQIREEKARTRELETLQQTVEELQAQVHSMDGAKGWFERRLKEAEESLQQQQQEQEEALKQCREQHAAELKGKEEELQDVRDQLEQAQEERDCHLKTISSLKQEVKDTVDGQRILEKKGSAALKDLKRQLHLERKRADKLQERLQDILTNSKSRSGLEELVLSEMNSPSRTQTGDSSSISSFSYREILREKESSAVPARSLSSSPQAQPPRPAELSDEEVAELFQRLAETQQEKWMLEEKVKHLEVSSASMAEDLCRKSAIIETYVMDSRIDVSVAAGHTDRSGLGSVLRDLVKPGDENLREMNKKLQNMLEEQLTKNMHLHKDMEVLSQEIVRLSKECVGPPDPDLEPGETS

SEQ ID NO: 48272 - protein, 474 aa, Homo sapiens
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKHSDFASNCCSINSPPLYCDSEIDAELKNIL

SEQ ID NO: 48273 - protein, 145 aa, Homo sapiens
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEIC

SEQ ID NO: 48274 - protein, 493 aa, Homo sapiens
MLWSWSEERGGAARLSGRKMKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKHSDFASNCCSINSPPLYCDSEIDAELKNIL

SEQ ID NO: 48275 - protein, 222 aa, Homo sapiens
MAASVRQARSLLGVAATLAPGSRGYRARPPPRRRPGPRWPDPEDLLTPRWQLGPRYAAKQFARYGAASGVVPGSLWPSPEQLRELEAEEREWYPSLATMQESLRVKQLAEEQKRREREQHIAECMAKMPQMIVNWQQQQRENWEKAQADKERRARLQAEAQELLGYQVDPRSARFQELLQDLEKKERKRLKEEKQKRKKEARAAALAAAVAQDPAASGAPSS

SEQ ID NO: 48276 - protein, 345 aa, Homo sapiens
MVAALLGGGGEARGGTVPGAWLCLMALLQLLGSAPRGSGLAHGRRLICWQALLQCQGEPECSYAYNQYAEACAPVLAQHGGGDAPGAAAAAFPASAASFSSRWRCPSHCISALIQLNHTRRGPALEDCDCAQDENCKSTKRAIEPCLPRTSGGGAGGPGAGGVMGCTEARRRCDRDSRCNLALSRYLTYCGKVFNGLRCTDECRTVIEDMLAMPKAALLNDCVCDGLERPICESVKENMARLCFGAELGNGPGSSGSDGGLDDYYDEDYDDEQRTGGAGGEQPLDDDDGVPHPPRPGSGAAASGGRGDLPYGPGRRSSGGGGRLAPRGAWTPLASILLLLLGPLF

SEQ ID NO: 48277 - protein, 313 aa, Homo sapiens
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLVLHKQPREVCLCLLELGRIAARYGVEPPGLIKLEKEIEQEETLSAPSPSPSPSSKSSGKKSTGNLLDDAVKRISEDPPCKCPNKFCVERLSQGRYRVGEKILFIRMLHNKHVMVRVGGGWETFAGYLLKHDPCRMLQISRVDGKTSPIQSKSPTLKDMNPDNYLVVSASYKAKKEIK

SEQ ID NO: 48278 - protein, 313 aa, Homo sapiens; identical to SEQ ID NO: 48277

SEQ ID NO: 48279 - protein, 313 aa, Homo sapiens; identical to SEQ ID NO: 48277

SEQ ID NO: 48280 - protein, 181 aa, Homo sapiens
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLVLHKQPREVCLCLLELGRIAARYGVEPPGLIKLEKEIEQEETLSA

SEQ ID NO: 48281 - protein, 205 aa, Homo sapiens
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLVLHKQPREVCLCLLELGRIAARYGVEPPGLIKLEKEIEQEETLSAPSPSPSPSSKSSGKKSTGNLLDDA

SEQ ID NO: 48282 - protein, 136 aa, Homo sapiens
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGL

SEQ ID NO: 48283 - protein, 155 aa, Homo sapiens
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLVLHKQPREVCLCLLELGRI

SEQ ID NO: 48284 - protein, 680 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPRPRDQLPPHPRSRRYSGDSDSSASSAQSGPLGTRSDDTGTGPRRERPSRRLTTGTPASPRRPPLRSQSRDRLDRGRPRGAPGGRGAQLSVPSPARRARSQSREEQAVLLVRRDRDGQHSWVPRGRGSGGSGRSTPQTPRARSPAAPRLSRVSSPSPELGTTPASIFRTPLQLDPQQEQQLFRRLEEEFLANARALEAVASVTPTGPAPDPARAPDPPAPDSAYCSSSSSSSSLSVLGGKCGQPGDSGRTANGLPGPRSQALSSSSDEGSPCPGMGGPLDAPGSPLACTEPSRTWARGRMDTQPDRKPSRIPTPRGPRRPSGPAELGTWHALHSVTPRAEPDSWM

SEQ ID NO: 48285 - protein, 337 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPR

SEQ ID NO: 48286 - protein, 329 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTGPGISCPPIPAPAATPGTVTPQPPPPRAAPLVPAVMTQALAPGGSDPAGG

SEQ ID NO: 48287 - protein, 537 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPRPRDQLPPHPRSRRYSGDSDSSASSAQSGPLGTRSDDTGTGPRRERPSRRLTTGTPASPRRPPACAASPETGWIAAGPGGPQEAGEPSCRSPALPGGPGARAARSRLCCLCAGIETGSTHGCQGAGAVGARAGAPPRLPVPAALQHPGFPGSPAPVQSWAPHRPASSAHPCSSTRSRSSSCSGAWKRSSWPMPGPLRLLLA

SEQ ID NO: 48288 - protein, 537 aa, Homo sapiens; identical to SEQ ID NO: 48287

SEQ ID NO: 48289 - protein, 537 aa, Homo sapiens; identical to SEQ ID NO: 48287

SEQ ID NO: 48290 - protein, 138 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVL

SEQ ID NO: 48291 - protein, 143 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEV

SEQ ID NO: 48292 - protein, 537 aa, Homo sapiens; identical to SEQ ID NO: 48287

SEQ ID NO: 48293 - protein, 678 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 48294 - protein, 624 aa, Homo sapiens
MCMCQASPPPAALAGCLLSSCVQPAREHGGAFSKAEWLSNCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 48295 - protein, 721 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCELEAGWPLPRHRRDSGPAARPGRGAQGSRSEGHIPDRRGPRPWQDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 48296 - protein, 379 aa, Homo sapiens
MFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 48297 - protein, 405 aa, Homo sapiens
MDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 48298 - protein, 476 aa, Homo sapiens
MSGARCRTLYPFSGERHGQGLRFAAGELITLLQVPDGGWWEGEKEDGLRGWFPASYVQLLEKPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 48299 - protein, 416 aa, Homo sapiens
MKPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 48300 - protein, 336 aa, Homo sapiens
MSNMENSFDDVSCLSPQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 48301 - protein, 415 aa, Homo sapiens
KPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 48302 - protein, 416 aa, Homo sapiens; identical to SEQ ID NO: 48299

SEQ ID NO: 48303 - protein, 181 aa, Homo sapiens
MVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITELERLEVERVEMIRQHLCQYTQLRHETDMFNQSTVEPVDQLLRKVDPAKDRELWVREHKTGNIRPVDMEI

SEQ ID NO: 48304 - protein, 290 aa, Homo sapiens
MPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 48305 - protein, 125 aa, Homo sapiens
MKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 48306 - protein, 336 aa, Homo sapiens; identical to SEQ ID NO: 48300

SEQ ID NO: 48307 - protein, 478 aa, Homo sapiens
MAPKKKGKKGKAKGTPIVDGLAPEDMSKEQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 48308 - protein, 453 aa, Homo sapiens
MSKEQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 48309 - protein, 174 aa, Homo sapiens
MAPKKKGKKGKAKGTPIVDGLAPEDMSKEQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKLRPSMIRR

SEQ ID NO: 48310 - protein, 382 aa, Homo sapiens
MVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLETFFC

SEQ ID NO: 48311 - protein, 238 aa, Homo sapiens
MLCCMRRTKQVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 48312 - protein, 274 aa, Homo sapiens
MTKSCSELCHPALHFLPCLGGLRKNLQRAVRPSPYSLGFLTFWISRVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 48313 - protein, 372 aa, Homo sapiens
MPPPQQGPCGHHLLLLLALLLPSLPLTRAPVPPGPAAALLQALGLRDEPQGAPRLRPVPPVMWRLFRRRDPQETRSGSRRTSPGVTLQPCHVEELGVAGNIVRHIPDRGAPTRASEPASAAGHCPEWTVVFDLSAVEPAERPSRARLELRFAAAAAAAPEGGWELSVAQAGQGAGADPGPVLLRQLVPALGPPVRAELLGAAWARNASWPRSLRLALALRPRAPAACARLAEASLLLVTLDPRLCHPLARPRRDAEPVLGGGPGGACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 48314 - protein, 407 aa, Homo sapiens
MVLAAPLLLGFLLLALELRPRGEAAEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 48315 - protein, 380 aa, Homo sapiens
  MOD_RES (1)..(1): Any amino acid
XAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 48316 - protein, 308 aa, Homo sapiens
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 48317 - protein, 308 aa, Homo sapiens; identical to SEQ ID NO: 48316

SEQ ID NO: 48318 - protein, 429 aa, Homo sapiens
MCPGALWVALPLLSLLAGSLQGKPLQSWGRGSAGGNAHSPLGVPGGGLPEHTFNLKMFLENVKVDFLRSLNLSGVPSQDKTRVEPPQYMIDLYNRYTSDKSTTPASNIVRSFSMEDAISITATEDFPFQKHILLFNISIPRHEQITRAELRLYVSCQNHVDPSHDLKGSVVIYDVLDGTDAWDSATETKTFLVSQDIQDEGWETLEVSSAVKRWVRSDSTKSKNKLEVTVESHRKGCDTLDISVPPGSRNLPFFVVFSNDHSSGTKETRLELREMISHEQESVLKKLSKDGSTEAGESSHEEDTDGHVAAGSTLARRKRSAGAGSHCQKTSLRVNFEDIGWDSWIIAPKEYEAYECKGGCFFPLADDVTPTKHAIVQTLVHLKFPTKVGKACCVPTKLSPISVLYKDDMGVPTLKYHYEGMSVAECGCR

SEQ ID NO: 48319 - protein, 364 aa, Homo sapiens
MLRFLPDLAFSFLLILALGQAVQFQEYVFLQFLGLDKAPSPQKFQPVPYILKKIFQDREAAATTGVSRDLCYVKELGVRGNVLRFLPDQGFFLYPKKISQASSCLQKLLYFNLSAIKEREQLTLAQLGLDLGPNSYYNLGPELELALFLVQEPHVWGQTTPKPGKMFVLRSVPWPQGAVHFNLLDVAKDWNDNPRKNFGLFLEILVKEDRDSGVNFQPEDTCARLRCSLHASLLVVTLNPDQCHPSRKRRAAIPVPKLSCKNLCHRHQLFINFRDLGWHKWIIAPKGFMANYCHGECPFSLTISLNSSNYAFMQALMHAVDPEIPQAVCIPTKLSPISMLYQDNNDNVILRHYEDMVVDECGCG

SEQ ID NO: 48320 - protein, 501 aa, Homo sapiens
MRLPKLLTFLLWYLAWLDLEFICTVLGAPDLGQRPQGTRPGLAKAEAKERPPLARNVFRPGGHSYGGGATNANARAKGGTGQTGGLTQPKKDEPKKLPPRPGGPEPKPGHPPQTRQATARTVTPKGQLPGGKAPPKAGSVPSSFLLKKAREPGPPREPKEPFRPPPITPHEYMLSLYRTLSDADRKGGNSSVKLEAGLANTITSFIDKGQDDRGPVVRKQRYVFDISALEKDGLLGAELRILRKKPSDTAKPAAPGGGRAAQLKLSSCPSGRQPASLLDVRSVPGLDGSGWEVFDIWKLFRNFKNSAQLCLELEAWERGRAVDLRGLGFDRAARQVHEKALFLVFGRTKKRDLFFNEIKARSGQDDKTVYEYLFSQRRKRRAPLATRQGKRPSKNLKARCSRKALHVNFKDMGWDDWIIAPLEYEAFHCEGLCEFPLRSHLEPTNHAVIQTLMNSMDPESTPPTCCVPTRLSPISILFIDSANNVVYKQYEDMVVESCGCR

SEQ ID NO: 48321 - protein, 501 aa, Homo sapiens; identical to SEQ ID NO: 48320

SEQ ID NO: 48322 - protein, 455 aa, Homo sapiens
MDTPRVLLSAVFLISFLWDLPGFQQASISSSSSSAELGSTKGMRSRKEGKMQRAPRDSDAGREGQEPQPRPQDEPRAQQPRAQEPPGRGPRVVPHEYMLSIYRTYSIAEKLGINASFFQSSKSANTITSFVDRGLDDLSHTPLRRQKYLFDVSMLSDKEELVGAELRLFRQAPSAPWGPPAGPLHVQLFPCLSPLLLDARTLDPQGAPPAGWEVFDVWQGLRHQPWKQLCLELRAAWGELDAGEAEARARGPQQPPPPDLRSLGFGRRVRPPQERALLVVFTRSQRKNLFAEMREQLGSAEAAGPGAGAEGSWPPPSGAPDARPWLPSPGRRRRRTAFASRHGKRHGKKSRLRCSKKPLHVNFKELGWDDWIIAPLEYEAYHCEGVCDFPLRSHLEPTNHAIIQTLMNSMDPGSTPPSCCVPTKLTPISILYIDAGNNVVYKQYEDMVVESCGCR

SEQ ID NO: 48323 - protein, 353 aa, Homo sapiens
MDTPRVLLSAVFLISFLWDLPGFQQASISSSSSSAELGSTKGMRSRKEGKMQRAPRDSDAGREGQEPQPRPQDEPRAQQPRAQEPPGRGPRVVPHEYMLSIYRTYSIAEKLGINASFFQSSKSANTITSFVDRGLDDLSHTPLRRQKYLFDVSMLSDKEELVGAELRLFRQAPSAPWGPPAGPLHVQLFPCLSPLLLDARTLDPQGAPPAGWEVFDVWQGLRHQPWKQLCLELRAAWGELDAGEAEARARGPQQPPPPDLRSLGFGRRVRPPQERALLVVFTRSQRKNLFAPGVRGLSLRGCMRLPAALAPGAHQPRHHPDADELHGPRLHPAQLLRAHQIDSHQHSIHRRGQ

SEQ ID NO: 48324 - protein, 271 aa, Homo sapiens [sequence omitted]

SEQ ID NO: 48325 - protein, 450 aa, Homo sapiens
MDLSAAAALCLWLLSACRPRDGLEAAAVLRAAGAGPVRSPGGGGGGGGGGRTLAQAAGAAAVPAAAVPRARAARRAAGSGFRNGSVVPHHFMMSLYRSLAGRAPAGAAAVSASGHGRADTITGFTDQATQDESAAETGQSFLFDVSSLNDADEVVGAELRVLRRGSPESGPGSWTSPPLLLLSTCPGAARAPRLLYSRAAEPLVGQRWEAFDVADAMRRHRREPRPPRAFCLLLRAVAGPVPSPLALRRLGFGWPGGGGSAAEERAVLVVSSRTQRKESLFREIRAQARALGAALASEPLPDPGTGTASPRAVIGGRRRRRTALAGTRTAQGSGGGAGRGHGRRGRSRCSRKPLHVDFKELGWDDWIIAPLDYEAYHCEGLCDFPLRSHLEPTNHAIIQTLLNSMAPDAAPASCCVPARLSPISILYIDAANNVVYKQYEDMVVEACGCR

SEQ ID NO: 48326 - protein, 422 aa, Homo sapiens
MPRSFLVKSKKAHSYHQPRSPGPDYSLRLENVPAPSRADSTSNAGGAKAEPRDRLSPESQLTEAPDRASASPDSCEGSVCERSSEFEDFWRPPSPSASPASEKSMCPSLDEAQPFPLPFKPYSWSGLAGSDLRHLVQSYRPCGALERGAGLGLFCEPAPEPGHPAALYGPKRAAGGAGAGAPGSCSAGAGATAGPGLGLYGDFGSAAAGLYERPTAAAGLLYPERGHGLHADKGAGVKVESELLCTRLLLGGGSYKCIKCSKVFSTPHGLEVHVRRSHSGTRPFACEMCGKTFGHAVSLEQHKAVHSQERSFDCKICGKSFKRSSTLSTHLLIHSDTRPYPCQYCGKRFHQKSDMKKHTFIHTGEKPHKCQVCGKAFSQSSNLITHSRKHTGFKPFGCDLCGKGFQRKVDLRRHRETQHGLK

SEQ ID NO: 48327 - protein, 422 aa, Homo sapiens; identical to SEQ ID NO: 48326

SEQ ID NO: 48328 - protein, 422 aa, Homo sapiens; identical to SEQ ID NO: 48326

SEQ ID NO: 48329 - protein, 330 aa, Homo sapiens
MPRSFLVKSKKAHTYHQPRVQEDEPLWPPALTPVPRDQAPSNSPVLSTLFPNQCLDWTNLKREPELEQDQNLARMAPAPEGPIVLSRPQDGDSPLSDSPPFYKPSFSWDTLATTYGHSYRQAPSTMQSAFLEHSVSLYGSPLVPSTEPALDFSLRYSPGMDAYHCVKCNKVFSTPHGLEVHVRRSHSGTRPFACDICGKTFGHAVSLEQHTHVHSQERSFECRMCGKAFKRSSTLSTHLLIHSDTRPYPCQFCGKRFHQKSDMKKHTYIHTGEKPHKCQVCGKAFSQSSNLITHSRKHTGFKPFSCELCTKGFQRKVDLRRHRESQHNLK

SEQ ID NO: 48330 - protein, 330 aa, Homo sapiens; identical to SEQ ID NO: 48329

SEQ ID NO: 48331 - protein, 284 aa, Homo sapiens
MPRSFLVKSKKAHTYHQPRVQEDEPLWPPALTPVPRDQAPSNSPVLSTLFPNQCLDWTNLKREPELEQDQNLARMAPAPEGPIVLSRPQDGDSPLSDSPPFYKPSFSWDTLATTYGHSYRQAPSTMQSAFLEHSVSLYGSPLVPSTEPALDFSLRYSPGMDAYHCVKCNKERSFECRMCGKAFKRSSTLSTHLLIHSDTRPYPCQFCGKRFHQKSDMKKHTYIHTGEKPHKCQVCGKAFSQSSNLITHSRKHTGFKPFSCELCTKGFQRKVDLRRHRESQHNLK

SEQ ID NO: 48332 - protein, 284 aa, Homo sapiens; identical to SEQ ID NO: 48331

SEQ ID NO: 48333 - protein, 330 aa, Homo sapiens; identical to SEQ ID NO: 48329

SEQ ID NO: 48334 - protein, 284 aa, Homo sapiens; identical to SEQ ID NO: 48331

SEQ ID NO: 48335 - protein, 540 aa, Homo sapiens
MTTSLQDGQSAASRAAARDSPLAAQVCGAAQGRGDAHDLAPAPWLHARALLPLPDGTRGCAADRRKKKDLDVPEMPSIPNPFPELCCSPFTSVLSADLFPKANSRKKQVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVDGVFLVRDSQSNPKTFVLSMSHGQKIKHFQIIPVEDDGEMFHTLDDGHTRFTDLIQLVEFYQLNKGVLPCKLKHYCARIAL

SEQ ID NO: 48336 - protein, 453 aa, Homo sapiens
MSLSARRVTLPAITPIILQKRVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVDGVFLVRDSQSNPKTFVLSMSHGQKIKHFQIIPVEDDGEMFHTLDDGHTRFTDLIQLVEFYQLNKGVLPCKLKHYCARIAL

SEQ ID NO: 48337 - protein, 532 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 48338 - protein, 447 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAACSWSGRVSGTPRALSSLCATCRK

SEQ ID NO: 48339 - protein, 447 aa, Homo sapiens; identical to SEQ ID NO: 48338

SEQ ID NO: 48340 - protein, 532 aa, Homo sapiens; identical to SEQ ID NO: 48337

SEQ ID NO: 48341 - protein, 532 aa, Homo sapiens; identical to SEQ ID NO: 48337

SEQ ID NO: 48342 - protein, 555 aa, Homo sapiens
MGKWRPGQGHTTGSVKPLSCSDAMELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 48343 - protein, 205 aa, Homo sapiens
MAAPGERGRFHGGNLFFLPGGARSEMMDDLATDARGRGAGRRDAAASASTPAQAPTSDSPVAEDASRRRPCRACVDFKTWMRTQQKRDTKFREDCPPDREELGRHSWAVLHTLAAYYPDLPTPEQQQDMAQFIHLFSKFYPCEECAEDLRKRLCRNHPDTRTRACFTQWLCHLHNEVNRKLGKPDFDCSKVDERWRDGWKDGSCD

SEQ ID NO: 48344 - protein, 94 aa, Homo sapiens
MRTQQKRDTKFREDCPPDREELGRHSWAVLHTLAAYYPDLPTPEQQQDMAQFIHLFSKFYPCEECAEDLRKRLCRNHPDTRTRACFTVAVPPAQ

SEQ ID NO: 48345 - protein, 638 aa, Homo sapiens
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 48346 - protein, 294 aa, Homo sapiens
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQSQN

SEQ ID NO: 48347 - protein, 616 aa, Homo sapiens
MDLWQLLLTLALAGSSDAFSGSEDSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 48348 - protein, 451 aa, Homo sapiens
MVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 48349 - protein, 108 aa, Homo sapiens
MPLWVFFFVILTLSNSSHCSPPPPLTLRMRRYADAIFTNSYRKVLGQLSARKLLQDIMSRQQGESNQERGARARLGRQVDSMWAEQKQMELESILVALLQKHSRNSQG

SEQ ID NO: 48350 - protein, 107 aa, Homo sapiens
MPLWVFFFVILTLSNSSHCSPPPPLTLRMRRYADAIFTNSYRKVLGQLSARKLLQDIMSRQQGESNQERGARARLGRQVDSMWAEQKQMELESILVALLQKHRNSQG

SEQ ID NO: 48351 - protein, 108 aa, Homo sapiens; identical to SEQ ID NO: 48349

SEQ ID NO: 48352 - protein, 423 aa, Homo sapiens
MDRRMWGAHVFCVLSPLPTVLGHMHPECDFITQLREDESACLQAAEEMPNTTLGCPATWDGLLCWPTAGSGEWVTLPCPDFFSHFSSESGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 48353 - protein, 68 aa, Homo sapiens
MVPGTPSPLLGRGKELWLESLACLPGAVKRDCTITGWSEPFPPYPVACPVPLELLAEEGCPCSSLARG

SEQ ID NO: 48354 - protein, 145 aa, Homo sapiens
MVPGTPSPLLGRGKELWLESLACLPGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTGCPCSSLARG

SEQ ID NO: 48355 - protein, 151 aa, Homo sapiens
MLPFSTATTLTTAASPLAARALHWHVGELQTGLRGHRVLGPGRHLPLLVDHQRAHCPLGRGELWAFSQYYPHPGEETGASSGQPPYPVSVLASLQVDTFPDPTLWNSLHHLQLPARQCWPGHPPPPGAGTGFLPGLHCCHPLLLPQPRGED

SEQ ID NO: 48356 - protein, 359 aa, Homo sapiens
MVPGTPSPLLGRGKELWLESLACLPGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 48357 - protein, 366 aa, Homo sapiens
MWNATPSEEPGFNLTLADLDWDASPGNDSLGDELLQLFPAPLLAGVTATCVALFVVGIAGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVIFVIWAVAFCSAGPIFVLVGVEHENGTDPWDTNECRPTEFAVRSGLLTVMVWVSSIFFFLPVFCLTVLYSLIGRKLWRRRRGDAVVGASLRDQNHKQTVKMLAVVVFAFILCWLPFHVGRYLFSKSFEPGSLEIAQISQYCNLVSFVLFYLSAAINPILYNIMSKKYRVAVFRLLGFEPFSQRKLSTLKDESSRAWTESSINT

SEQ ID NO: 48358 - protein, 289 aa, Homo sapiens
MWNATPSEEPGFNLTLADLDWDASPGNDSLGDELLQLFPAPLLAGVTATCVALFVVGIAGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVIFVIWAVAFCSAGPIFVLVGVEHENGTDPWDTNECRPTEFAVRSGLLTVMVWVSSIFFFLPVFCLTVLYSLIGRKLWRRRRGDAVVGASLRDQNHKQTVKMLGGSQRALRLSLAGPILSLCLLPSL

SEQ ID NO: 48359 - protein, 1949 aa, Homo sapiens
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHYAAALMAVSGLPQMKNYTSVETLEITQNLLNSPKQCPCGHGLMVLLRVPCSPLAVVAYERLAHVRARLALEEHFEIILGSPSSGVTVGKHFVKQLRMWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGEHARSPQPRGPAEEGRAPGEKQRPRASQGPPSAISRHSPGPTPQPDCSLRTGQRSVQVSVTSSCSQLSSSSGSSSSSVAPAAGTWVLQASQCSLTKACRQPPIVFLPKLVYDMVVSTDSSGLPKAASLLPSPSVMWASSFRPLLSKTMTSTEQSLYYRQWTVPRPSHMDYGNRAEGRVDGFHPRRLLLSGPPQIGKTGAYLQFLSVLSRMLVRLTEVDVYDEEEININLREESDWHYLQLSDPWPDLELFKKLPFDYIIHDPKYEDASLICSHYQGIKSEDRGMSRKPEDLYVRRQTARMRLSKYAAYNTYHHCEQCHQYMGFHPRYQLYESTLHAFAFSYSMLGEEIQLHFIIPKSKEHHFVFSQPGGQLESMRLPLVTDKSHEYIKSPTFTPTTGRHEHGLFNLYHAMDGASHLHVLVVKEYEMAIYKKYWPNHIMLVLPSIFNSAGVGAAHFLIKELSYHNLELERNRQEELGIKPQDIWPFIVISDDSCVMWNVVDVNSAGERSREFSWSERNVSLKHIMQHIEAAPDIMHYALLGLRKWSSKTRASEVQEPFSRCHVHNFIILNVDLTQNVQYNQNRFLCDDVDFNLRVHSAGLLLCRFNRFSVMKKQIVVGGHRSFHITSKVSDNSAAVVPAQYICAPDSKHTFLAAPAQLLLEKFLQHHSHLFFPLSLKNHDHPVLSVDCYLNLGSQISVCYVSSRPHSLNISCSDLLFSGLLLYLCDSFVGASFLKKFHFLKGATLCVICQDRSSLRQTVVRLELEDEWQFRLRDEFQTANAREDRPLFFLTGRHI

SEQ ID NO: 48360 - protein, 409 aa, Homo sapiens
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKVFVNGATQMVALGPAEPASPRSL

SEQ ID NO: 48361 - protein, 457 aa, Homo sapiens
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAHQIRNPDV

SEQ ID NO: 48362 - protein, 1949 aa, Homo sapiens; identical to SEQ ID NO: 48359

SEQ ID NO: 48363 - protein, 395 aa, Homo sapiens
MTLRRLRKLQQKEEAAATPDPAARTPDSEVAPAAPVPTPGPPAAAATPGPPADELYAALEDYHPAELYRALAVSGGTLPRRKGSGFRWKNLSQSPEQQRKVLTLEKEDNQTFGFEIQTYGLHHREEQRVEMVTFVCRVHESSPAQLAGLTPGDTIASVNGLNVEGIRHREIVDIIKASGNVLRLETLYGTSIRKAELEARLQYLKQTLYEKWGEYRSLMVQEQRLVHGLVVKDPSIYDTLESVRSCLYGAGLLPGSLPFGPLLAVPGRPRGGARRARGDADDAVYHTCFFGDSEPPALPPPPPPARAFGPGPAETPAVGPGPGPRAALSRSASVRCAGPGGGGGGGAPGALWTEAREQALCGPGLRKTKYRSFRRRLLKFIPGLNRSLEEEESQL

SEQ ID NO: 48364 - protein, 252 aa, Homo sapiens
MTLLPSKGGDTIASVNGLNVEGIRHREIVDIIKASGNVLRLETLYGTSIRKAELEARLQYLKQTLYEKWGEYRSLMVQEQRLVHGLVVKDPSIYDTLESVRSCLYGAGLLPGSLPFGPLLAVPGRPRGGARRARGDADDAVYHTCFFGDSEPPALPPPPPPARAFGPGPAETPAVGPGPGPRAALSRSASVRCAGPGGGGGGGAPGALWTEAREQALCGPGLRKTKYRSFRRRLLKFIPGLNRSLEEEESQL

SEQ ID NO: 48365 - protein, 252 aa, Homo sapiens; identical to SEQ ID NO: 48364

SEQ ID NO: 48366 - protein, 217 aa, Homo sapiens
MAAQCVRLARRSLPALALSLRPSPRLLCTATKQKNSGQNLEEDMGQSEQKADPPATEKTLLEEKVKLEEQLKETVEKYKRALADTENLRQRSQKLVEEAKLYGIQAFCKDLLEVADVLEKATQCVPKEEIKDDNPHLKNLYEGLVMTEVQIQKVFTKHGLLKLNPVGAKFDPYEHEALFHTPVEGKEPGTVALVSKVGYKLHGRTLRPALVGVVKEA

SEQ ID NO: 48367 - protein, 196 aa, Homo sapiens
MAAQCVRLARRSLPALALSLRPSPRLLCTATKQKNSGQNLEEDMGQSEQLKETVEKYKRALADTENLRQRSQKLVEEAKLYGIQAFCKDLLEVADVLEKATQCVPKEEIKDDNPHLKNLYEGLVMTEVQIQKVFTKHGLLKLNPVGAKFDPYEHEALFHTPVEGKEPGTVALVSKVGYKLHGRTLRPALVGVVKEA

SEQ ID NO: 48368 - protein, 959 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQGTASSLGFSPPALPPERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 48369 - protein, 944 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 48370 - protein, 976 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCLSAAQHRAATSQLEGRVVRRVLTVASRALCPTGGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 48371 - protein, 669 aa, Homo sapiens
MATERSRSAMDSPVPASMFAPEPSSPGAARAAAAAARLHGGFDSDCSEDGEALNGEPELDLTSKLVLVSPTSEQYDSLLRQMWERMDEGCGETIYVIGQGSDGTEYGLSEADMEASYATVKSMAEQIEADVILLRERQEAGGRVRDYLVRKRVGDNDFLEVRVAVVGNVDAGKSTLLGVLTHGELDNGRGFARQKLFRHKHEIESGRTSSVGNDILGFDSEGNVVNKPDSHGGSLEWTKICEKSTKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNFSSERMCPIFQISNVTGENLDLLKMFLNLLSPRTSYREEEPAEFQIDDTYSVPGVGTVVSGTTLRGLIKLNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLQTTNNSPMNSKPQQIKMQSTKKGPLTKRDEGGPSGGPAVGAPPPGDEASSVGAGQPAASSNLQPQPKPSSGGRRRGGQRHKVKSQGACVTPASGC

SEQ ID NO: 48372 - protein, 514 aa, Homo sapiens
MKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 48373 - protein, 602 aa, Homo sapiens
MDSRVSELFGGCCRPGGGPAVGGTLKARGAGSSSGCGGPKGKKKNGRNRGGKANNPPYLPPEAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 48374 - protein, 244 aa, Homo sapiens
MKWRLQEGRGEAIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 48375 - protein, 153 aa, Homo sapiens
  MOD_RES (1)..(1): Any amino acid
XGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVARERGVLSATCSLPTFWRGAKLGVARKGQS

SEQ ID NO: 48376 - protein, 154 aa, Homo sapiens
  MOD_RES (1)..(1): Any amino acid
XGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKVRGTWPSISPEVRKEGGLPQTGRELLDPTMGIKPHLGWVAA

SEQ ID NO: 48377 - protein, 180 aa, Homo sapiens
MQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVARERGVLSATCSLPTFWRGAKLGVARKGQS

SEQ ID NO: 48378 - protein, 316 aa, Homo sapiens
  MOD_RES (1)..(1): Any amino acid
XQGGGAREENTSFRSRDPREEGQRLDSQAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVT

SEQ ID NO: 48379 - protein, 227 aa, Homo sapiens
MDSRVSELFGGCCRPGGGPAVGGTLKARGAGSSSGCGGPKGKKKNGRNRGGKANNPPYLPPEAEDGNIEYKYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGE

SEQ ID NO: 48380 - protein, 406 aa, Homo sapiens
MAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRVDQQVKSLSSVLSRYQGFSGEDGGSKNCFGRSGAVLYIRVPVGTLVKEGGRVVADLSCVGDEYIAALGGAGGKGNRFFLANNNRAPVTCTPGQPGQQRVLHLELKTVAHAGMVGFPNAGKSSLLRAISNARPAVASYPFTTLKPHVGIVHYEGHLQIAVADIPGIIRGAHQNRGLGSAFLRHIERCRFLLFVVDLSQPEPWTQVDDLKYELEMYEKGLSARPHAIVANKIDLPEAQANLSQLRDHLGQEVIVLSALTGENLEQLLLHLKVLYDAYAEAELGQGRQPLRW

SEQ ID NO: 48381 - protein, 248 aa, Homo sapiens
MAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRVADIPGIIRGAHQNRGLGSAFLRHIERCRFLLFVVDLSQPEPWTQVDDLKYELEMYEKGLSARPHAIVANKIDLPEAQANLSQLRDHLGQEVIVLSALTGENLEQLLLHLKVLYDAYAEAELGQGRQPLRW

SEQ ID NO: 48382 - protein, 233 aa, Homo sapiens
MAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRVDQQVKSLSSVLSRYQGFSGEDGGSKNCFGRSGAVLYIRVPVGTLVKEGGRVVADLSCVGDEYIAALGGAGGKGNRFFLANNNRAPVTCTPGQPGQQRVLHLELKTVAHAGMVGFP

SEQ ID NO: 48383 - protein, 178 aa, Homo sapiens
MVGFPNAGKSSLLRAISNARPAVASYPFTTLKPHVGIVHYEGHLQIAVADIPGIIRGAHQNRGLGSAFLRHIERCRFLLFVVDLSQPEPWTQVDDLKYELEMYEKGLSARPHAIVANKIDLPEAQANLSQLRDHLGQEVIVLSALTGENLEQLLLHLKVLYDAYAEAELGQGRQPLRW

SEQ ID NO: 48384 - protein, 287 aa, Homo sapiens
RSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTAHAGTLPSRMTVLYVDTIGFLSQLPHGLIESFSATLEDVAHSDLILHVRDVSHPEAELQKCSVLSTLRGLQLPAPLLDSMVEVHNKVDLVPGYSPTEPNVVPVSALRGHGLQELKAELDAAVLKATGRQILTLRVRLAGAQLSWLYKEATVQEVDVIPEDGAADVRVIISNSAYGKFRKLFPG

SEQ ID NO: 48385 - protein, 287 aa, Homo sapiens
  MOD_RES (1)..(1): Any amino acid
XSNLKRDVAHLYRGVGSRYIMGSGESFMQLQQRLLREKEAKIRKALDRLRKKRHLLRRQRTRREFPVISVVGYTNCGKTTLIKALTGDAAIQPRDQLFATLDVTAHAGTLPSRMTVLYVDTIGFLSQLPHGLIESFSATLEDVAHSDLILHVRDVSHPEAELQKCSVLSTLRGLQLPAPLLDSMVEVHNKVDLVPGYSPTEPNVVPVSALRGHGLQELKAELDAAVLKATGRQILTLRVRLAGAQLSWLYKEATVQEVDVIPEDGAADVRVIISNSAYGKFRKLFPG

SEQ ID NO: 48386 - protein, 296 aa, Homo sapiens
MTLNNVTMRQGTVGMQPQQQRWSIPADGRHLMVQKEPHQYSHRNRHSATPEDHCRRSWSSDSTDSVISSESGNTYYRVVLIGEQGVGKSTLANIFAGVHDSMDSDCEVLGEDTYERTLMVDGESATIILLDMWENKGENEWLHDHCMQVGDAYLIVYSITDRASFEKASELRIQLRRARQTEDIPIILVGNKSDLVRCREVSVSEGRACAVVFDCKFIETSAAVQHNVKELFEGIVRQVRLRRDSKEKNERRLAYQKRKESMPRKARRFWGKIVAKNNKNMAFKLKSKSCHDLSVL

SEQ ID NO: 48387 - protein, 296 aa, Homo sapiens; identical to SEQ ID NO: 48386

SEQ ID NO: 48388 - protein, 93 aa, Homo sapiens
MTLNNVTMRQGTVGMQPQQQRWSIPADGRHLMVQKEPHQYSHRNRHSATPEDHCRRSWSSDSTDSVISSESGNTYYRVVLIGEQGVGKSTLAN

SEQ ID NO: 48389 - protein, 308 aa, Homo sapiens
MVMEKPSPLLVGREFVRQYYTLLNQAPDMLHRFYGKNSSYVHGGLDSNGKPADAVYGQKEVEEPEERQQTPEVVPDDSGTFYDQAVVSNDMEEHLEEPVAEPEPDPEPEPEQEPVSEIQEEKPPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 48390 - protein, 466 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 48391 - protein, 466 aa, Homo sapiens; identical to SEQ ID NO: 48390

SEQ ID NO: 48392 - protein, 105 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQAL

SEQ ID NO: 48393 - protein, 122 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPESLKKK

SEQ ID NO: 48394 - protein, 117 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPE

SEQ ID NO: 48395 - protein, 122 aa, Homo sapiens; identical to SEQ ID NO: 48393

SEQ ID NO: 48396 - protein, 106 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALR

SEQ ID NO: 48397 - protein, 284 aa, Homo sapiens [sequence omitted]

SEQ ID NO: 48398 - protein, 1452 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTGDNHDRDLSSKLLYHSDKEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 48399 - protein, 497 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIGKENFSYWSFLLNLIFH

SEQ ID NO: 48400 - protein, 1478 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTGDNHDRDLSSKLLYHSDKEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 48401 - protein, 1487 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHDFLYILQPKQHFQHIEAEADMRIQLSSSAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQEKDKDDLGPDRFSTLTDDPSPRLSAQAQVAEDILDKYRNAIKRTSPSDGAMANYESTEVMGDGESAHDSPRDEALQNISADDLPDSASQAAHPQDSAFSYRDAKKKLRLALCSADSVAFPVLTHSTRNGLPDHTDPEDNEIVCFLKVQIAEAINLQDKNLMAQLQETMRCVCRFDNRTCRKLLASIAEDYRKRAPYIAYLTRCRQGLQTTQAHLERLLQRVLRDKEVANRYFTTVCVRLLLESKEKKIREFIQDFQKLTAADDKTAQVEDFLQFLYGAMAQDVIWQNASEEQLQDAQLAIERSVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 48402 - protein, 837 aa, Homo sapiens
  MOD_RES (1)..(1): Any amino acid
XNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPFRKKEKQE

SEQ ID NO: 48403 - protein, 830 aa, Homo sapiens
  MOD_RES (1)..(1): Any amino acid
XLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIGQQLAAITAWDSSATNITSHITVVTPFATRSRSRTNMLMDLHMDHEGSSQETIQEVQPEEVLVISLGTGPQLTPGMMSENEVLNMQLSDGGQGDVPVDENKLHGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPF

SEQ ID NO: 48404 - protein, 171 aa, Homo sapiens
MVQWPRMSYGKTRVMNRIFKLAFYPNQDGDILRDQVLHEHIQRLSKVVTANHRALQIPEVYLREAPWPSAQSEIRTISAYKTPRDKVQCILRMCSTIMNLLSLANEDSVPGADDFVPVLVFVLIKANPPCLLSTVQYISSFYASCLSGEESYWWMQFTAAVEFIKTIDDRK

SEQ ID NO: 48405 - protein, 117 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAG

SEQ ID NO: 48406 - protein, 988 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHGAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPK

SEQ ID NO: 48407 - protein, 1478 aa, Homo sapiens; identical to SEQ ID NO: 48400

SEQ ID NO: 48408 - protein, 756 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREA

SEQ ID NO: 48409 - protein, 306 aa, Homo sapiens
MGGRKMATDEENVYGLEENAQSRQESTRRLILVGRTGAGKSATGNSILGQRRFFSRLGATSVTRACTTGSRRWDKCHVEVVDTPDIFSSQVSKTDPGCEERGHCYLLSAPGPHALLLVTQLGRFTAQDQQAVRQVRDMFGEDVLKWMVIVFTRKEDLAGGSLHDYVSNTENRALRELVAECGGRVCAFDNRATGREQEAQVEQLLGMVEGLVLEHKGAHYSNEVYELAQVLRWAGPEERLRRVAERVAARVQRRPWGAWLSARLWKWLKSPRSWRLGLALLLGGALLFWVLLHRRWSEAVAEVGPD

SEQ ID NO: 48410 - protein, 337 aa, Homo sapiens
MDQNEHSHWGPHAKGQCASRSELRIILVGKTGTGKSAAGNSILRKQAFESKLGSQTLTKTCSKSQGSWGNREIVIIDTPDMFSWKDHCEALYKEVQRCYLLSAPGPHVLLLVTQLGRYTSQDQQAAQRVKEIFGEDAMGHTIVLFTHKEDLNGGSLMDYMHDSDNKALSKLVAACGGRICAFNNRAEGSNQDDQVKELMDCIEDLLMEKNGDHYTNGLYSLIQRSKCGPVGSDERVKEFKQSLIKYMETQRSYTALAEANCLKGALIKTQLCVLFCIQLFLRLIILWLCILHSMCNLFCCLLFSMCNLFCSLLFIIPKKLMIFLRTVIRLERKTPRL

SEQ ID NO: 48411 - protein, 329 aa, Homo sapiens
MAAQYGSMSFNPSTPGASYGPGRQEPRNSQLRIVLVGKTGAGKSATGNSILGRKVFHSGTAAKSITKKCEKRSSSWKETELVVVDTPGIFDTEVPNAETSKEIIRCILLTSPGPHALLLVVPLGRYTEEEHKATEKILKMFGERARSFMILIFTRKDDLGDTNLHDYLREAPEDIQDLMDIFGDRYCALNNKATGAEQEAQRAQLLGLIQRVVRENKEGCYTNRMYQRAEEEIQKQTQAMQELHRVELEREKARIREEYEEKIRKLEDKVEQEKRKKQMEKKLAEQEAHYAVRQQRARTEVESKDGILELIMTALQIASFILLRLFAED

SEQ ID NO: 48412 - protein, 261 aa, Homo sapiens
MAAQYGSMSFNPSTPGASYGPGRQEPRNSQLRIVLVGKTGAGKSATGNSILGRKVFHSGTAAKSITKKILKMFGERARSFMILIFTRKDDLGDTNLHDYLREAPEDIQDLMDIFGDRYCALNNKATGAEQEAQRAQLLGLIQRVVRENKEGCYTNRMYQRAEEEIQKQTQAMQELHRVELEREKARIREEYEEKIRKLEDKVEQEKRKKQMEKKLAEQEAHYAVRQQRARTEVESKDGILELIMTALQIASFILLRLFAED

SEQ ID NO: 48413 - protein, 151 aa, Homo sapiens
MAAQYGSMSFNPSTPGASYGERAFSAPQTRLQGGPGRQEPRNSQLRIVLVGKTGAGKSATGNSILGRKVFHSGTAAKSITKKCEKRSSSWKETELVVVDTPGIFDTEVPNAETSKEIIRCILLTSPGPHALLLVVPLGRYTEEEHKATEKI

SEQ ID NO: 48414 - protein, 307 aa, Homo sapiens
MGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 48415 - protein, 343 aa, Homo sapiens
MELSAPAHGSSLTASAQPPSVTATLEDRAQQPFLERMGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 48416 - protein, 292 aa, Homo sapiens
MEEEEYEQIPQENPPEELSQDPVLELSGGLREKEQKTPRRLRLILMGKTGSGKSATGNSILGRDVFESKLSTRPVTKTSQRRSREWAGKELEVIDTPNILSPQVSPEVADAICQAIVLSAPGPHAVLLVTQLGRFTDEDQQVVRRLQEVFGVGVLGHTILVFTRKEDLAGGSLEDYVRETNNQALAWLDVTLARRHCGFNNRAQGEEQEAQLRELMEKVEAIMWENEGDYYSNKAYQYTQQNFRLKELQERQVSQGQGSEDVPGEESWLEGLSQIQKESEEAHRCLLGKADL

SEQ ID NO: 48417 - protein, 353 aa, Homo sapiens
KPWYWVSWCSIGQVSLFFLGSALALGENVQPHLQGCGPRMVAQRWFQGRCWSFTICPCSLGVHPEAPGDDKMGYMGPYPSSLCFLWIFLGLREKEQKTPRRLRLILMGKTGSGKSATGNSILGRDVFESKLSTRPVTKTSQRRSREWAGKELEVIDTPNILSPQVSPEVADAICQAIVLSAPGPHAVLLVTQLGRFTDEDQQVVRRLQEVFGVGVLGHTILVFTRKEDLAGGSLEDYVRETNNQALAWLDVTLARRHCGFNNRAQGEEQEAQLRELMEKVEAIMWENEGDYYSNKAYQYTQQNFRLKELQERQVSQGQGSEDVPGEESWLEGLSQIQKESEEAHRCLLGKADL

SEQ ID NO: 48418 - protein, 62 aa, Homo sapiens
MEEEEYEQIPQENPPEELSQDPVLELSGGLARGGRRYLPSHRLIRPRAPRRAPGDTTGPVHG

SEQ ID NO: 48419 - protein, 387 aa, Homo sapiens
MVHCSCVLFRKYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIGELNKENDRILVAQGGLGGKLLTNFLPLKGQKRIIHLDLKLIADVGLVGFPNAGKSSLLSCVSHAKPAIADYAFTTLKPELGKIMYSDFKQISVADLPGLIEGAHMNKGMGHKFLKHIERTRQLLFVVDISGFQLSSHTQYRTAFETIILLTKELELYKEELQTKPALLAVNKMDLPDAQDKFHELMSQLQNPKDFLHLFEKNMIPERTVEFQHIIPISAVTGEGIEELKNCIRKSLDEQANQENDALHKKQLLNLWISDTMSSTEPPSKHAVTTSKMDII

SEQ ID NO: 48420 - protein, 308 aa, Homo sapiens
MVHCSCVLFRKYGNFIDKLRLFTRGGSGGMGYPRLGGEGGKGGDVWVVAQNRMTLKQLKDRYPRKRFVAGVGANSKFPNAGKSSLLSCVSHAKPAIADYAFTTLKPELGKIMYSDFKQISVADLPGLIEGAHMNKGMGHKFLKHIERTRQLLFVVDISGFQLSSHTQYRTAFETIILLTKELELYKEELQTKPALLAVNKMDLPDAQDKFHELMSQLQNPKDFLHLFEKNMIPERTVEFQHIIPISAVTGEGIEELKNCIRKSLDEQANQENDALHKKQLLNLWISDTMSSTEPPSKHAVTTSKMDII

SEQ ID NO: 48421 - protein, 236 aa, Homo sapiens
MSAPSATPIFAPGENCSPAWGAAPAAYDAADTHLRILGKPVMERWETPYMHALAAAASSKGGRVLEVGFGMAIAASKVQEAPIDEHWIIECNDGVFQRLRDWAPRQTHKVIPLKGLWEDVAPTLPDGHFDGILYDTYPLSEETWHTHQFNFIKNHAFRLLKPGGVLTYCNLTSWGELMKSKYSDITIMFEETQVPALLEAGFRRENIRTEVMALVPPADCRYYAFPQMITPLVTKG

SEQ ID NO: 48422 - protein, 269 aa, Homo sapiens
MSAPSATPIFAPGENCSPAWGAAPAAYDAADTHLRILGKPVMERWETPYMHALAAAASSKGGRVLEVGFGMAIAASKVQEAPIDEHWIIECNDGVFQRLRDWAPRQTHKVIPLKGLWEDVAPTLPDGHFDGILYDTYPLSEETWHTHQFNFIKNHAFRLLKPGGVLTYCNLTSWGELMKSKYSDITIMFEVRPPEVPHGSPGSDLGWGWEGAAGATLLPGEGPFLTPWVGWTVLVHLEIKVLCLAQWLPGAVAQVYNPSTVEGRGGQIA

SEQ ID NO: 48423 - protein, 471 aa, Homo sapiens
MCAAQMPPLAHIFRGTFVHSTWTCPMEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 48424 - protein, 454 aa, Homo sapiens
MCAAQMPPLAHIFRGTFVHSTWTCPMEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 48425 - protein, 393 aa, Homo sapiens
MFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 48426 - protein, 410 aa, Homo sapiens
MEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 48427 - protein, 195 aa, Homo sapiens
MTLFQNTRRPLRNRSRKLRDCHSVTQAGVQWRDLSSLKPPPPVFKRFSCLSLPSSWDYRFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGT

SEQ ID NO: 48428 - protein, 179 aa, Homo sapiens
ERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 48429 - protein, 454 aa, Homo sapiens; identical to SEQ ID NO: 48424

SEQ ID NO: 48430 - protein, 380 aa, Homo sapiens
MPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 48431 - protein, 693 aa, Homo sapiens
MALCNGDSKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVGVQGDCRSYSYVCGISSKDEPDWESLIFLARLIPRMCHNVNRVVYIFGPPVKEPPTDVTPTFLTTGVLSTLRQADFEAHNILRESGYAGKISQMPVILTPLHFDRDPLQKQPSCQRSVVIRTFITSDFMTGIPATPGNEIPVEVVLKMVTEIKKIPGISRIMYDLTSKPPGTTEWE

SEQ ID NO: 48432 - protein, 642 aa, Homo sapiens
MLEETLRMATTTIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVGVQGDCRSYSYVCGISSKDEPDWESLIFLARLIPRMCHNVNRVVYIFGPPVKEPPTDVTPTFLTTGVLSTLRQADFEAHNILRESGYAGKISQMPVILTPLHFDRDPLQKQPSCQRSVVIRTFITSDFMTGIPATPGNEIPVEVVLKMVTEIKKIPGISRIMYDLTSKPPGTTEWE

SEQ ID NO: 48433 - protein, 693 aa, Homo sapiens; identical to SEQ ID NO: 48431

SEQ ID NO: 48434 - protein, 381 aa, Homo sapiens
MSGVVRTLSRCLLPAEAGGARERRAGSGARDAEREARRRSRDIDALLARERRAVRRLVKILLLGAGESGKSTFLKQMRIIHGREFDQKALLEFRDTIFDNILKGSRVLVDARDKLGIPWQYSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 48435 - protein, 233 aa, Homo sapiens
MIYPLIVLPLCASWHWGLIRKGIVLFWGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 48436 - protein, 288 aa, Homo sapiens
MRIIHGREFDQKALLEFRDTIFDNILKGSRVLVDARDKLGIPWQYSENEKHGMFLMAFENKAGLPVEPATFQLYVPALSALWRDSGIREAFSRRSEFQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 48437 - protein, 359 aa, Homo sapiens
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATLGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLV

SEQ ID NO: 48438 - protein, 352 aa, Homo sapiens
MADFLPSRSVLSVCFPGCLLTSGEAEQQRKSKEIDKCLSREKTYVKRLVKILLLGAGESGKSTYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 48439 - protein, 377 aa, Homo sapiens
MADFLPSRSVLSVCFPGCLLTSGEAEQQRKSKEIDKCLSREKTYVKRLVKILLLGAGESGKSTFLKQMRIIHGQDFDQRAREEFRPTIYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 48440 - protein, 282 aa, Homo sapiens
MRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 48441 - protein, 355 aa, Homo sapiens
MAGCCCLSAEEKESQRISAEIERQLRRDKKDARRELKLLLLGTGESGKSTFIKQMRIIHGSGYSDEDRKGFTKLVYQNIFTAMQAMIRAMDTLRIQYVCEQNKENAQIIREVEVDKVSMLSREQVEAIKQLWQDPGIQECYDRRREYQLSDSAKYYLTDIDRIATPSFVPTQQDVLRVRVPTTGIIEYPFDLENIIFRMVDVGGQRSERRKWIHCFESVTSIIFLVALSEYDQVLAECDNENRMEESKALFKTIITYPWFLNSSVILFLNKKDLLEEKIMYSHLISYFPEYTGPKQDVRAARDFILKLYQDQNPDKEKVIYSHFTCATDTDNIRFVFAAVKDTILQLNLREFNLV

SEQ ID NO: 48442 - protein, 374 aa, Homo sapiens
MARSLTWRCCPWCLTEDEKAAARVDQEINRILLEQKKQDRGELKLLLLGPGESGKSTFIKQMRIIHGAGYSEEERKGFRPLVYQNIFVSMRAMIEAMERLQIPFSRPESKHHASLVMSQDPYKVTTFEKRYAAAMQWLWRDAGIRAYYERRREFHLLDSAVYYLSHLERITEEGYVPTAQDVLRSRMPTTGINEYCFSVQKTNLRIVDVGGQKSERKKWIHCFENVIALIYLASLSEYDQCLEENNQENRMKESLALFGTILELPWFKSTSVILFLNKTDILEEKIPTSHLATYFPSFQGPKQDAEAAKRFILDMYTRMYTGCVDGPEGSKKGARSRRLFSHYTCATDTQNIRKVFKDVRDSVLARYLDEINLL

SEQ ID NO: 48443 - protein, 354 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYTGPNTYEDAAAYIQAQFESKNRSPNKEIYCHMTCATDTNNIQVVFDAVTDIIIANNLRGCGLY

SEQ ID NO: 48444 - protein, 354 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLKLFDSICNNKWFTDTSIILFLNKKDIFEEKIKKSPLTICFPEYTGPSAFTEAVAYIQAQYESKNKSAHKEIYTHVTCATDTNNIQFVFDAVTDVIIAKNLRGCGLY

SEQ ID NO: 48445 - protein, 381 aa, Homo sapiens
MGCLGGNSKTTEDQGVDEKERREANKKIEKQLQKERLAYKATHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 48446 - protein, 458 aa, Homo sapiens
MGLCYSLRPLLFGGPGDDPCAASEPPVEDAQPAPAPALAPVRAAARDTARTLLPRGGEGSPACARPKADKPKEKRQRTEQLSAEEREAAKEREAVKEARKVSRGIDRMLRDQKRDLQQTHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 48447 - protein, 381 aa, Homo sapiens; identical to SEQ ID NO: 48445

SEQ ID NO: 48448 - protein, 381 aa, Homo sapiens; identical to SEQ ID NO: 48445

SEQ ID NO: 48449 - protein, 174 aa, Homo sapiens
MFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 48450 - protein, 320 aa, Homo sapiens
MRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 48451 - protein, 354 aa, Homo sapiens
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 48452 - protein, 23 aa, Homo sapiens
MGCTLSAEDKAAVERSKMIDRNL

SEQ ID NO: 48453 - protein, 302 aa, Homo sapiens
MKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 48454 - protein, 339 aa, Homo sapiens
MEYAGHLPASSAQGTILACTSCTGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 48455 - protein, 355 aa, Homo sapiens
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 48456 - protein, 339 aa, Homo sapiens
MTEGVKTLGWTKQKGGCHWGRSEGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 48457 - protein, 303 aa, Homo sapiens
MKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 48458 - protein, 318 aa, Homo sapiens
MRGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 48459 - protein, 274 aa, Homo sapiens
MAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 48460 - protein, 361 aa, Homo sapiens
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKSRKLFRENYLKLSDPDQQPPPAPLPSDSVP

SEQ ID NO: 48461 - protein, 354 aa, Homo sapiens
MGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARADDARQLFVLAGSAEEGVMTPELAGVIKRLWRDGGVQACFSRSREYQLNDSASYYLNDLDRISQSNYIPTQQDVLRTRVKTTGIVETHFTFKDLYFKMFDVGGQRSERKKWIHCFEGVTAIIFCVALSDYDLVLAEDEEMNRMHESMKLFDSICNNKWFTETSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 48462 - protein, 350 aa, Homo sapiens
MGAGASAEEKHSRELEKKLKEDAEKDARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFERASEYQLNDSAGYYLSDLERLVTPGYVPTEQDVLRSRVKTTGIIETQFSFKDLNFRMFDVGGQRSERKKWIHCFEGVTCIIFIAALSAYDMVLVEDDEVNRMHESLHLFNSICNHRYFATTSIVLFLNKKDVFFEKIKKAHLSICFPDYDGPNTYEDAGNYIKVQFLELNMRRDVKEIYSHMTCATDTQNVKFVFDAVTDIIIKENLKDCGLF

SEQ ID NO: 48463 - protein, 350 aa, Homo sapiens; identical to SEQ ID NO: 48462

SEQ ID NO: 48464 - protein, 354 aa, Homo sapiens
MGSGASAEDKELAKRSKELEKKLQEDADKEAKTVKLLLLGAGESGKSTIVKQMKIIHQDGYSPEECLEFKAIIYGNVLQSILAIIRAMTTLGIDYAEPSCADDGRQLNNLADSIEEGTMPPELVEVIRRLWKDGGVQACFERAAEYQLNDSASYYLNQLERITDPEYLPSEQDVLRSRVKTTGIIETKFSVKDLNFRMFDVGGQRSERKKWIHCFEGVTCIIFCAALSAYDMVLVEDDEVNRMHESLHLFNSICNHKFFAATSIVLFLNKKDLFEEKIKKVHLSICFPEYDGNNSYDDAGNYIKSQFLDLNMRKDVKEIYSHMTCATDTQNVKFVFDAVTDIIIKENLKDCGLF

SEQ ID NO: 48465 - protein, 355 aa, Homo sapiens
MGCRQSSEEKEAARRSRRIDRHLRSESQRQRREIKLLLLGTSNSGKSTIVKQMKIIHSGGFNLEACKEYKPLIIYNAIDSLTRIIRALAALRIDFHNPDRAYDAVQLFALTGPAESKGEITPELLGVMRRLWADPGAQACFSRSSEYHLEDNAAYYLNDLERIAAADYIPTVEDILRSRDMTTGIVENKFTFKELTFKMVDVGGQRSERKKWIHCFEGVTAIIFCVELSGYDLKLYEDNQTSRMAESLRLFDSICNNNWFINTSLILFLNKKDLLAEKIRRIPLTICFPEYKGQNTYEEAAVYIQRQFEDLNRNKETKEIYSHFTCATDTSNIQFVFDAVTDVIIQNNLKYIGLC

SEQ ID NO: 48466 - protein, 303 aa, Homo sapiens [sequence omitted]

SEQ ID NO: 48467 - protein, 395 aa, Homo sapiens
MCDQTFLVNVFGSCDKCFKQRALRPVFKKSQQLSYCSTCAEIMATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 48468 - protein, 353 aa, Homo sapiens
MATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 48469 - protein, 283 aa, Homo sapiens
MATEGLHENETLASLKSEAESLKGKLEEERAKLHDVELHQVAERVEALGQFVMKTRRTLKGHGNKVLCMDWCKDKRRIVSSSQDGKVIVWDSFTTNKILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 48470 - protein, 193 aa, Homo sapiens
MSKLLILILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 48471 - protein, 340 aa, Homo sapiens [sequence omitted]

SEQ ID NO: 48472 - protein, 340 aa, Homo sapiens [sequence omitted]

SEQ ID NO: 48473 - protein, 198 aa, Homo sapiens
  MOD_RES (1)..(1): Any amino acid
XGYLSCCRFLDDNQIVTSSGDTTCALWDIETGQQTTTFTGHTGDVMSLSLAPDTRLFVSGACDASAKLWDVREGMCRQTFTGHESDINAICFFPNGNAFATGSDDATCRLFDLRADQELMTYSHDNIICGITSVSFSKSGRLLLAGYDDFNCNVWDALKADRAGVLAGHDNRVSCLGVTDDGMAVATGSWDSFLKIWN

SEQ ID NO: 48474 - protein, 147 aa, Homo sapiens
MSELDQLRQEAEQLKNQIRDARKACADATLSQITNNIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTGTCP

SEQ ID NO: 48475 - protein, 108 aa, Homo sapiens
MSELDQLRQEAEQLKNQIRDARKACADATLSQITNNIDPVGRIQMRTRRTLRGHLAKIYAMHWGTDSRLLVSASQDGKLIIWDSYTTNKVHAIPLRSSWVMTCAYAPS

SEQ ID NO: 48476 - protein, 134 aa, Homo sapiens
MSELDQLRQEAEQLKNQIRITNNIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTGTCP

SEQ ID NO: 48477 - protein, 240 aa, Homo sapiens
MTCAYAPSGNYVACGGLDNICSIYNLKTREGNVRVSRELAGHTGYLSCCRFLDDNQIVTSSGDTTCALWDIETGQQTTTFTGHTGDVMSLSLAPDTRLFVSGACDASAKLWDVREGMCRQTFTGHESDINAICFFPNGNAFATGSDDATCRLFDLRADQELMTYSHDNIICGITSVSFSKSGRLLLAGYDDFNCNVWDALKADRAGVLAGHDNRVSCLGVTDDGMAVATGSWDSFLKIWN

SEQ ID NO: 48478 - protein, 327 aa, Homo sapiens
MTAPCPPPPPDPQFVLRGTQSPVHALHFCEGAQAQGRPLLFSGSQSGLVHIWSLQTRRAVTTLDGHGGQCVTWLQTLPQGRQLLSQGRDLKLCLWDLAEGRSAVVDSVCLESVGFCRSSILAGGQPRWTLAVPGRGSDEVQILEMPSKTSVCALKPKADAKLGMPMCLRLWQADCSSRPLLLAGYEDGSVVLWDVSEQKVCSRIACHEEPVMDLDFDSQKARGISGSAGKALAVWSLDWQQALQVRGTHELTNPGIAEVTIRPDRKILATAGWDHRIRVFHWRTMQPLAVLAFHSAAVQCVAFTADGLLAAGSKDQRISLWSLYPRA

SEQ ID NO: 48479 - protein, 327 aa, Homo sapiens; identical to SEQ ID NO: 48478

SEQ ID NO: 48480 - protein, 212 aa, Homo sapiens
MTAPCPPPPPDPQFVLRGTQSPVHALHFCEGAQAQGRPLLFSGSQSGLVHIWSLQTRRAVTTLDGHGGQCVTWLQTLPQGRQLLSQGRDLKLCLWDLAEGRSAVVDSVCLESVGFCRSSILAGGQPRWTLAVPGRGSDEVQILEMPSKTSVCALKPKADAKLGMPMCLRLWQADCSSRPLLLAGYEDGSVVLWDVSEQKVCSRIACHEEPGL

SEQ ID NO: 48481 - protein, 340 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 48482 - protein, 340 aa, Homo sapiens; identical to SEQ ID NO: 48481

SEQ ID NO: 48483 - protein, 340 aa, Homo sapiens; identical to SEQ ID NO: 48481

SEQ ID NO: 48484 - protein, 152 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFL

SEQ ID NO: 48485 - protein, 240 aa, Homo sapiens
MTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 48486 - protein, 296 aa, Homo sapiens
MRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 48487 - protein, 240 aa, Homo sapiens; identical to SEQ ID NO: 48485

SEQ ID NO: 48488 - protein, 232 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAV

SEQ ID NO: 48489 - protein, 296 aa, Homo sapiens; identical to SEQ ID NO: 48486

SEQ ID NO: 48490 - protein, 251 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCR

SEQ ID NO: 48491 - protein, 340 aa, Homo sapiens [sequence omitted]

SEQ ID NO: 48492 - protein, 340 aa, Homo sapiens
MSELEQLRQEAEQLRNQIQDARKACNDATLVQITSNMDSVGRIQMRTRRTLRGHLAKIYAMHWGYDSRLLVSASQDGKLIIWDSYTTNKMHAIPLRSSWVMTCAYAPSGNYVACGGLDNICSIYNLKTREGNVRVSRELPGHTGYLSCCRFLDDSQIVTSSGDTTCALWDIETAQQTTTFTGHSGDVMSLSLSPDMRTFVSGACDASSKLWDIRDGMCRQSFTGHVSDINAVSFFPNGYAFATGSDDATCRLFDLRADQELLLYSHDNIICGITSVAFSKSGRLLLAGYDDFNCNVWDTLKGDRAGVLAGHDNRVSCLGVTDDGMAVATGSWDSFLRIWN

SEQ ID NO: 48493 - protein, 340 aa, Homo sapiens; identical to SEQ ID NO: 48492

SEQ ID NO: 48494 - protein, 79 aa, Homo sapiens
MSELEQLRQEAEQLRNQIQDARKACNDATLVQITSNMDSVGRIQMRTRRTLRGHLAKIYAMHWGYDSRLLVSASQDGKL

SEQ ID NO: 48495 - protein, 67 aa, Homo sapiens
MEEWDVPQMKKEVESLKYQLAFQREMASKTIPELLKWIEDGIPKDPFLNPDLMKNNPWVEKGKCTIL

SEQ ID NO: 48496 - protein, 71 aa, Homo sapiens
MASNNTASIAQARKLVEQLKMEANIDRIKVSKAAADLMAYCEAHAKEDPLLTPVPASENPFREKKFFCAIL

SEQ ID NO: 48497 - protein, 102 aa, Homo sapiens
MQGKLQPPMEREARDGVPSGKVFLKDLSSTPMASNNTASIAQARKLVEQLKMEANIDRIKVSKAAADLMAYCEAHAKEDPLLTPVPASENPFREKKFFCAIL

SEQ ID NO: 48498 - protein, 71 aa, Homo sapiens; identical to SEQ ID NO: 48496

SEQ ID NO: 48499 - protein, 71 aa, Homo sapiens; identical to SEQ ID NO: 48496

SEQ ID NO: 48500 - protein, 71 aa, Homo sapiens; identical to SEQ ID NO: 48496

SEQ ID NO: 48501 - protein, 71 aa, Homo sapiens; identical to SEQ ID NO: 48496

SEQ ID NO: 48502 - protein, 110 aa, Homo sapiens
MVYLQAKTRIPEHRKVTQLIKCWSPDLNPVFLKDLSSTPMASNNTASIAQARKLVEQLKMEANIDRIKVSKAAADLMAYCEAHAKEDPLLTPVPASENPFREKKFFCAIL

SEQ ID NO: 48503 - protein, 68 aa, Homo sapiens
MSGSSSVAAMKKVVQQLRLEAGLNRVKVSQAAADLKQFCLQNAQHDPLLTGVSSSTNPFRPQKVCSFL

SEQ ID NO: 48504 - protein, 68 aa, Homo sapiens; identical to SEQ ID NO: 48503

SEQ ID NO: 48505 - protein, 74 aa, Homo sapiens
MPVINIEDLTEKDKLKMEVDQLKKEVTLERMLVSKCCEEVRDYVEERSGEDPLVKGIPEDKNPFKELKGGCVIS

SEQ ID NO: 48506 - protein, 74 aa, Homo sapiens; identical to SEQ ID NO: 48505

SEQ ID NO: 48507 - protein, 69 aa, Homo sapiens
MAQDLSEKDLLKMEVEQLKKEVKNTRIPISKAGKEIKEYVEAQAGNDPFLKGIPEDKNPFKEKGGCLIS

SEQ ID NO: 48508 - protein, 69 aa, Homo sapiens; identical to SEQ ID NO: 48507

SEQ ID NO: 48509 - protein, 69 aa, Homo sapiens; identical to SEQ ID NO: 48507

SEQ ID NO: 48510 - protein, 69 aa, Homo sapiens; identical to SEQ ID NO: 48507

SEQ ID NO: 48511 - protein, 69 aa, Homo sapiens; identical to SEQ ID NO: 48507

SEQ ID NO: 48512 - protein, 359 aa, Homo sapiens
MTLESIMACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 48513 - protein, 157 aa, Homo sapiens
MVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 48514 - protein, 170 aa, Homo sapiens
MGERWADSQLDSRSTHGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSV

SEQ ID NO: 48515 - protein, 607 aa, Homo sapiens
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 48516 - protein, 407 aa, Homo sapiens
VVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 48517 - protein, 607 aa, Homo sapiens; identical to SEQ ID NO: 48515

SEQ ID NO: 48518 - protein, 264 aa, Homo sapiens
MGERVLWPLRAGQHWRHRPLPAGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQD

SEQ ID NO: 48519 - protein, 607 aa, Homo sapiens; identical to SEQ ID NO: 48515

SEQ ID NO: 48520 - protein, 429 aa, Homo sapiens
MEAAVVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 48521 - protein, 607 aa, Homo sapiens; identical to SEQ ID NO: 48515

SEQ ID NO: 48522 - protein, 404 aa, Homo sapiens
MSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 48523 - protein, 264 aa, Homo sapiens; identical to SEQ ID NO: 48518

SEQ ID NO: 48524 - protein, 264 aa, Homo sapiens; identical to SEQ ID NO: 48518

SEQ ID NO: 48525 - protein, 264 aa, Homo sapiens; identical to SEQ ID NO: 48518

SEQ ID NO: 48526 - protein, 607 aa, Homo sapiens; identical to SEQ ID NO: 48515

SEQ ID NO: 48527 - protein, 607 aa, Homo sapiens; identical to SEQ ID NO: 48515

SEQ ID NO: 48528 - protein, 264 aa, Homo sapiens; identical to SEQ ID NO: 48518

SEQ ID NO: 48529 - protein, 264 aa, Homo sapiens; identical to SEQ ID NO: 48518

SEQ ID NO: 48530 - protein, 607 aa, Homo sapiens; identical to SEQ ID NO: 48515

SEQ ID NO: 48531 - protein, 66 aa, Homo sapiens
VVNFPPALYEYVTGELGLALVLVLNKVDLAPPALVVAWKHYFHQHYPQLHVVLFTSFPRDPRTPQD

SEQ ID NO: 48532 - protein, 264 aa, Homo sapiens; identical to SEQ ID NO: 48518

SEQ ID NO: 48533 - protein, 404 aa, Homo sapiens; identical to SEQ ID NO: 48522

SEQ ID NO: 48534 - protein, 262 aa, Homo sapiens
MEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 48535 - protein, 262 aa, Homo sapiens; identical to SEQ ID NO: 48534

SEQ ID NO: 48536 - protein, 429 aa, Homo sapiens; identical to SEQ ID NO: 48520

SEQ ID NO: 48537 - protein, 404 aa, Homo sapiens; identical to SEQ ID NO: 48522

SEQ ID NO: 48538 - protein, 404 aa, Homo sapiens; identical to SEQ ID NO: 48522

SEQ ID NO: 48539 - protein, 262 aa, Homo sapiens; identical to SEQ ID NO: 48534

SEQ ID NO: 48540 - protein, 429 aa, Homo sapiens; identical to SEQ ID NO: 48520

SEQ ID NO: 48541 - protein, 429 aa, Homo sapiens; identical to SEQ ID NO: 48520

SEQ ID NO: 48542 - protein, 262 aa, Homo sapiens; identical to SEQ ID NO: 48534

SEQ ID NO: 48543 - protein, 404 aa, Homo sapiens; identical to SEQ ID NO: 48522

SEQ ID NO: 48544 - protein, 429 aa, Homo sapiens; identical to SEQ ID NO: 48520

SEQ ID NO: 48545 - protein, 429 aa, Homo sapiens; identical to SEQ ID NO: 48520

SEQ ID NO: 48546 - protein, 262 aa, Homo sapiens; identical to SEQ ID NO: 48534

SEQ ID NO: 48547 - protein, 429 aa, Homo sapiens; identical to SEQ ID NO: 48520

SEQ ID NO: 48548 - protein, 404 aa, Homo sapiens; identical to SEQ ID NO: 48522

SEQ ID NO: 48549 - protein, 404 aa, Homo sapiens; identical to SEQ ID NO: 48522

SEQ ID NO: 48550 - protein, 262 aa, Homo sapiens; identical to SEQ ID NO: 48534

SEQ ID NO: 48551 - protein, 731 aa, Homo sapiens
MVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYKVVMKQSKLPMSLLHDRIRPHNLKVHILDTESFETTFGPKSQRKRPNLFASDMQSLIENAEMSTESYDQGKDRDLVTEDTGVRNEAQEEIYKKGQSKRIWGELYKVIDSSDVVVQVLDARDPMGTRSPHIETYLKKEKPWKHLIFVLNKCDLVPTWATKRWVAVLSQDYPTLAFHASLTNPFGKGAFIQLLRQFGKLHTDKKQISVGFIGYPNVGKSSVINTLRSKKVCNVAPIAGETKVWQYITLMRRIFLIDCPGVVYPSEDSETDIVLKGVVQVEKIKSPEDHIGAVLERAKPEYISKTYKIDSWENAEDFLEKLAFRTGKLLKGGEPDLQTVGKMVLNDWQRGRIPFFVKPPNAEPLVAPQLLPSSSLEVVPEAAQNNPGEEVTETAGEGSESIIKEETEENSHCDANTEMQQILTRVRQNFGKINVVPQFSGDDLVPVEVSDLEEELESFSDEEEEEQEQQRDDAEESSSEPEEENVGNDTKAVIKALDEKIAKYQKFLDKAKAKKFSAVRISKGLSEKIFAKPEEQRKTLEEDVDDRAPSKKGKKRKAQREEEQEHSNKAPRALTSKERRRAVRQQRPKKVGVRYYETHNVKNRNRNKKKTNDSEGQKHKRKKFRQKQ

SEQ ID NO: 48552 - protein, 192 aa, Homo sapiens [sequence omitted]

SEQ ID NO: 48553 - protein, 537 aa, Homo sapiens
MTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 48554 - protein, 549 aa, Homo sapiens
MKRPKLKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 48555 - protein, 96 aa, Homo sapiens
MTCHKRYKIQKKVREHHRKLRKEAKKRGHKKPRKDPGVPNSAPFKEALLREAELRKQRLEELKQQQKLDRQKELEKKRKLETNPDIKPSNVEPMEK

SEQ ID NO: 48556 - protein, 135 aa, Homo sapiens
MTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEV

SEQ ID NO: 48557 - protein, 138 aa, Homo sapiens
MKRPKLKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVS

SEQ ID NO: 48558 - protein, 345 aa, Homo sapiens
MPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMAGNVVTGEMVEELILSGADIIKVGVGPGSVCTTRTKTGVGYPQLSAVIECADSAHGLKGHIISDGGCTCPGDVAKAFGAGADFVMLGGMFSGHTECAGEVFERNGRKLKLFYGMSSDTAMNKHAGGVAEYRASEGKTVEVPYKGDVENTILDILGGLRSTCTYVGAAKLKELSRRATFIRVTQQHNTVFS

SEQ ID NO: 48559 - protein, 409 aa, Homo sapiens
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRYVWRPRSLVIVWRQNSWLLRGGWYSSQRSMVNRGSMLGSVEKSLGLRNPEGEDNKVFPTLRASEGKTVEVPFKGDVEHTIRDILGGIRSTCTYVGAAKLKELSRRTTFIRVTQQVNPIFSEAC

SEQ ID NO: 48560 - protein, 348 aa, Homo sapiens
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 48561 - protein, 348 aa, Homo sapiens; identical to SEQ ID NO: 48560

SEQ ID NO: 48562 - protein, 366 aa, Homo sapiens
MTSCLPALRFIATPRLSAMPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 48563 - protein, 348 aa, Homo sapiens
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLESIWLPAQAQALLTLSSWNRSWKLFPRKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 48564 - protein, 348 aa, Homo sapiens; identical to SEQ ID NO: 48560

SEQ ID NO: 48565 - protein, 592 aa, Homo sapiens
MASEIHMTGPMCLIENTNGRLMANPEALKILSAITQPMVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTETLQELLDLHRDSEREAIEVFIRSSFKDVDHLFQKELAAQLEKKRDDFCKQNQEASSDRCSALLQVIFSPLEEEVKAGIYSKPGGYRLFVQKLQDLKKKYYEEPRKGIQAEEILQTYLKSKESMTDAILQTDQTLTEKEKEIEVERVKAESAQASAKMLQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 48566 - protein, 555 aa, Homo sapiens
MVVVAIVGLYRTGKSYLMNKLAGKKKGFSLGSTVQSHTKGIWMWCVPHPKKPGHILVLLDTEGLGDVEKGDNQNDSWIFALAVLLSSTFVYNSIGTINQQAMDQLYYVTELTHRIRSKSSPDENENEVEDSADFVSFFPDFVWTLRDFSLDLEADGQPLTPDEYLTYSLKLKKGTSQKDETFNLPRLCIRKFFPKKKCFVFDRPVHRRKLAQLEKLQDEELDPEFVQQVADFCSYIFSNSKTKTLSGGIQVNGPRLESLVLTYVNAISSGDLPCMENAVLALAQIENSAAVQKAIAHYEQQMGQKVQLPTETLQELLDLHRDSEREAIEVFIRSSFKDVDHLFQKELAAQLEKKRDDFCKQNQEASSDRCSALLQVIFSPLEEEVKAGIYSKPGGYRLFVQKLQDLKKKYYEEPRKGIQAEEILQTYLKSKESMTDAILQTDQTLTEKEKEIEVERVKAESAQASAKMLQEMQRKNEQMMEQKERSYQEHLKQLTEKMENDRVQLLKEQERTLALKLQEQEQLLKEGFQKESRIMKNEIQDLQTKMRRRKACTIS

SEQ ID NO: 48567 - protein, 591 aa, Homo sapiens
MAPEINLPGPMSLIDNTKGQLVVNPEALKILSAITQPVVVVAIVGLYRTGKSYLMNKLAGKKNGFSLGSTVKSHTKGIWMWCVPHPKKPEHTLVLLDTEGLGDIEKGDNENDSWIFALAILLSSTFVYNSMGTINQQAMDQLHYVTELTDRIKANSSPGNNSVDDSADFVSFFPAFVWTLRDFTLELEVDGEPITADDYLELSLKLRKGTDKKSKSFNDPRLCIRKFFPKRKCFVFDWPAPKKYLAHLEQLKEEELNPDFIEQVAEFCSYILSHSNVKTLSGGIPVNGPRLESLVLTYVNAISSGDLPCMENAVLALAQIENSAAVEKAIAHYEQQMGQKVQLPTETLQELLDLHRDSEREAIEVFMKNSFKDVDQMFQRKLGAQLEARRDDFCKQNSKASSDCCMALLQDIFGPLEEDVKQGTFSKPGGYRLFTQKLQELKNKYYQVPRKGIQAKEVLKKYLESKEDVADALLQTDQSLSEKEKAIEVERIKAESAEAAKKMLEEIQKKNEEMMEQKEKSYQEHVKQLTEKMERDRAQLMAEQEKTLALKLQEQERLLKEGFENESKRLQKDIWDIQMRSKSLEPICNIL

SEQ ID NO: 48568 - protein, 591 aa, Homo sapiens; identical to SEQ ID NO: 48567

SEQ ID NO: 48569 - protein, 440 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQD

SEQ ID NO: 48570 - protein, 595 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQEQARVLKERCQGESTQLQNEIQKLQKTLKKKTKRYMSHKLKI

SEQ ID NO: 48571 - protein, 563 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGNRKLAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQEQARVLKERCQGESTQLQNEIQKLQKTLKKKTKRYMSHKLKI

SEQ ID NO: 48572 - protein, 137 aa, Homo sapiens
QDEELDPEFVQQVADFCSYIFSNSKTKTLSGGIKAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQVSKC

SEQ ID NO: 48573 - protein, 640 aa, Homo sapiens
MGERTLHAAVPTPGYPESESIMMAPICLVENQEEQLTVNSKALEILDKISQPVVVVAIVGLYRTGKSYLMNRLAGKRNGFPLGSTVQSETKGIWMWCVPHLSKPNHTLVLLDTEGLGDVEKSNPKNDSWIFALAVLLSSSFVYNSVSTINHQALEQLHYVTELAELIRAKSCPRPDEAEDSSEFASFFPDFIWTVRDFTLELKLDGNPITEDEYLENALKLIPGKNPKIQNSNMPRECIRHFFRKRKCFVFDRPTNDKQYLNHMDEVPEENLERHFLMQSDNFCSYIFTHAKTKTLREGIIVTGKRLGTLVVTYVDAINSGAVPCLENAVTALAQLENPAAVQRAADHYSQQMAQQLRLPTDTLQELLDVHAACEREAIAVFMEHSFKDENHEFQKKLVDTIEKKKGDFVLQNEEASAKYCQAELKRLSEHLTESILRGIFSVPGGHNLYLEEKKQVEWDYKLVPRKGVKANEVLQNFLQSQVVVEESILQSDKALTAGEKAIAAERAMKEAAEKEQELLREKQKEQQQMMEAQERSFQEYMAQMEKKLEEERENLLREHERLLKHKLKVQEEMLKEEFQKKSEQLNKEINQLKEKIESTKNEQLRLLKILDMASNIMIVTLPGASKLLGVGTKYLGSRI

SEQ ID NO: 48574 - protein, 586 aa, Homo sapiens
MALEIHMSDPMCLIENFNEQLKVNQEALEILSAITQPVVVVAIVGLYRTGKSYLMNKLAGKNKGFSVASTVQSHTKGIWIWCVPHPNWPNHTLVLLDTEGLGDVEKADNKNDIQIFALALLLSSTFVYNTVNKIDQGAIDLLHNVTELTDLLKARNSPDLDRVEDPADSASFFPDLVWTLRDFCLGLEIDGQLVTPDEYLENSLRPKQGSDQRVQNFNLPRLCIQKFFPKKKCFIFDLPAHQKKLAQLETLPDDELEPEFVQQVTEFCSYIFSHSMTKTLPGGIMVNGSRLKNLVLTYVNAISSGDLPCIENAVLALAQRENSAAVQKAIAHYDQQMGQKVQLPMETLQELLDLHRTSEREAIEVFMKNSFKDVDQSFQKELETLLDAKQNDICKRNLEASSDYCSALLKDIFGPLEEAVKQGIYSKPGGHNLFIQKTEELKAKYYREPRKGIQAEEVLQKYLKSKESVSHAILQTDQALTETEKKKKEAQVKAEAEKAEAQRLAAIQRQNEQMMQERERLHQEQVRQMEIAKQNWLAEQQKMQEQQMQEQAAQLSTTFQAQNRSLLSELQHAQRTVNNDDPCVLL

SEQ ID NO: 48575 - protein, 586 aa, Homo sapiens; identical to SEQ ID NO: 48574

SEQ ID NO: 48576 - protein, 483 aa, Homo sapiens
MALEIHMSDPMCLIENFNEQLKVNQEALEILSAITQPVVVVAIVGLYRTGKSYLMNKLAGKNKGFSVASTVQSHTKGIWIWCVPHPNWPNHTLVLLDTEGLGDVEKADNKNDIQIFALALLLSSTFVYNTVNKIDQGAIDLLHNVTELTDLLKARNSPDLDRVEDPADSASFFPDLVWTLRDFCLGLEIDGQLVTPDEYLENSLRPKQGSDQRVQNFNLPRLCIQKFFPKKKCFIFDLPAHQKKLAQLETLPDDELEPEFVQQVTEFCSYIFSHSMTKTLPGGIMVNGSRLKNLVLTYVNAISSGDLPCIENAVLALAQRENSAAVQKAIAHYDQQMGQKVQLPMETLQELLDLHRTSEREAIEVFMKNSFKDVDQSFQKELETLLDAKQNDICKRNLEASSDYCSALLKDIFGPLEEAVKQGIYSKPGGHNLFIQKTEELKAKYYREPRKGIQAEEVLQKYLKSKESVSHAILQTDQALTET

SEQ ID NO: 48577 - protein, 638 aa, Homo sapiens
MASEIHMPGPVCLTENTKGHLVVNSEALEILSAITQPVVVVAIVGLYRTGKSYLMNKLAGKNKGFPLGCTVKSETKGIWMWCVPHPSKPNHTLILLDTEGLGDMEKSDPKSDSWIFALAVLLSSSFVYNSMGTINHQALEQLHYVTELTELIRAKSCPRPDEVEDSSEFVSFFPDFIWTVRDFTLELKLDGHPITEDEYLENALKLISGKNPQIQNSNKPREWIRHFFPKQKCFVFDRPINDKKLLLHVEEVREDQLDSNFQMQSENFCSYIFTHAKTKTLREGILVTGNRLGMLVETYLDAINSGATPCLENAMAVLAQCENSAAVQRAANHYSQQMAQQVRFPTDTLQELLDVHAVCEREAIAVFMEYSFKDKSQEFQKKLVDTMEKKKEDFVLQNEEASAKYCQAELKRLSELLTESISRGTFFVPGGHNIYLEAKKKIEQDYTLVPRKGVKADEVLQSFLQSQVVIEESILQSDKALTAGEKAIAAKQAKKEAAEKEQELLRQKQKEQQQMMEAQERSFQENIAQLKKKMERERENYMRELRKMLSHKMKVLEELLTEGFKEIFESLNEEINRLKEQIEAAENEEPSVFSQILDVAGSIFIAALPGAAKLVDLGMKILSSLCNRLRNPGKKIIS

SEQ ID NO: 48578 - protein, 633 aa, Homo sapiens
MESGPKMLAPVCLVENNNEQLLVNQQAIQILEKISQPVVVVAIVGLYRTGKSYLMNHLAGQNHGFPLGSTVQSETKGIWMWCVPHPSKPNHTLVLLDTEGLGDVEKGDPKNDSWIFALAVLLCSTFVYNSMSTINHQALEQLHYVTELTELIKAKSSPRPDGVEDSTEFVSFFPDFLWTVRDFTLELKLNGHPITEDEYLENALKLIQGNNPRVQTSNFPRECIRRFFPKRKCFVFDRPTNDKDLLANIEKVSEKQLDPKFQEQTNIFCSYIFTHARTKTLREGITVTGNRLGTLAVTYVEAINSGAVPCLENAVITLAQRENSAAVQRAADYYSQQMAQRVKLPTDTLQELLDMHAACEREAIAIFMEHSFKDENQEFQKKFMETTMNKKGDFLLQNEESSVQYCQAKLNELSKGLMESISAGSFSVPGGHKLYMETKERIEQDYWQVPRKGVKAKEVFQRFLESQMVIEESILQSDKALTDREKAVAVDRAKKEAAEKEQELLKQKLQEQQQQMEAQDKSRKENIAQLKEKLQMEREHLLREQIMMLEHTQKVQNDWLHEGFKKKYEEMNAEISQFKRMIDTTKNDDTPWIARTLDNLADELTAILSAPAKLIGHGVKGVSSLFKKHKLPF

SEQ ID NO: 48579 - protein, 503 aa, Homo sapiens
MSTINHQALEQLHYVTELTELIKAKSSPRPDGVEDSTEFVSFFPDFLWTVRDFTLELKLNGHPITEDEYLENALKLIQGNNPRVQTSNFPRECIRRFFPKRKCFVFDRPTNDKDLLANIEKVSEKQLDPKFQEQTNIFCSYIFTHARTKTLREGITVTGNRLGTLAVTYVEAINSGAVPCLENAVITLAQRENSAAVQRAADYYSQQMAQRVKLPTDTLQELLDMHAACEREAIAIFMEHSFKDENQEFQKKFMETTMNKKGDFLLQNEESSVQYCQAKLNELSKGLMESISAGSFSVPGGHKLYMETKERIEQDYWQVPRKGVKAKEVFQRFLESQMVIEESILQSDKALTDREKAVAVDRAKKEAAEKEQELLKQKLQEQQQQMEAQDKSRKENIAQLKEKLQMEREHLLREQIMMLEHTQKVQNDWLHEGFKKKYEEMNAEISQFKRMIDTTKNDDTPWIARTLDNLADELTAILSAPAKLIGHGVKGVSSLFKKHKLPF

SEQ ID NO: 48580 - protein, 604 aa, Homo sapiens
MESGPKMLAPVCLVENNNEQLLVNQQAIQILEKISQPVVVVAIVGLYRTGKSYLMNHLAGQNHGFPLDTEGLGDVEKGDPKNDSWIFALAVLLCSTFVYNSMSTINHQALEQLHYVTELTELIKAKSSPRPDGVEDSTEFVSFFPDFLWTVRDFTLELKLNGHPITEDEYLENALKLIQGNNPRVQTSNFPRECIRRFFPKRKCFVFDRPTNDKDLLANIEKVSEKQLDPKFQEQTNIFCSYIFTHARTKTLREGITVTGNRLGTLAVTYVEAINSGAVPCLENAVITLAQRENSAAVQRAADYYSQQMAQRVKLPTDTLQELLDMHAACEREAIAIFMEHSFKDENQEFQKKFMETTMNKKGDFLLQNEESSVQYCQAKLNELSKGLMESISAGSFSVPGGHKLYMETKERIEQDYWQVPRKGVKAKEVFQRFLESQMVIEESILQSDKALTDREKAVAVDRAKKEAAEKEQELLKQKLQEQQQQMEAQDKSRKENIAQLKEKLQMEREHLLREQIMMLEHTQKVQNDWLHEGFKKKYEEMNAEISQFKRMIDTTKNDDTPWIARTLDNLADELTAILSAPAKLIGHGVKGVSSLFKKHKLPF

SEQ ID NO: 48581 - protein, 432 aa, Homo sapiens
MKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYRLLKDCPGFVFTPRSREELPPNFPSEIPGICHFLDAYQQGTNSKPCFQKKDVEDGNANFLGKASGID

SEQ ID NO: 48582 - protein, 624 aa, Homo sapiens
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYR

SEQ ID NO: 48583 - protein, 763 aa, Homo sapiens
MSRRKISSESFSSLGSDYLETSPEEEGECPLSRLCWNGSRSPPGPLEPSPAAAAAAAAPAPTPAASAAAAAATAGARRVQRRRRVNLDSLGESISRLTAPSPQTIQQTLKRTLQYYEHQVIGYRDAEKNFHNISNRCSYADHSNKEEIEDVSGILQCTANILGLKFEEIQKRFGEEFFNICFHENERVLRAVGGTLQDFFNGFDALLEHIRTSFGKQATLESPSFLCKELPEGTLMLHYFHPHHIVGFAMLGMIKAAGKKIYRLDVEVEQVANEKLCSDVSNPGNCSCLTFLIKECENTNIMKNLPQGTSQVPADLRISINTFCRAFPFHLMFDPSMSVLQLGEGLRKQLRCDTHKVLKFEDCFEIVSPKVNATFERVLLRLSTPFVIRTKPEASGSENKDKVMEVKGQMIHVPESNSILFLGSPCVDKLDELMGRGLHLSDIPIHDATRDVILVGEQAKAQDGLKKRMDKLKATLERTHQALEEEKKKTVDLLYSIFPGDVAQQLWQGQQVQARKFDDVTMLFSDIVGFTAICAQCTPMQVISMLNELYTRFDHQCGFLDIYKVETIGDAYCVAAGLHRKSLCHAKPIALMALKMMELSEEVLTPDGRPIQPQRSELLFSFPVSIQLVPDQHQSETDLGTEKMRIGIHSGSVLAGVVGVRMPRYCLFGNNVTLASKFESGSHPRRINVSPTTYQLLKREESFTFIPRSREELPDNFPKEIPGICYFLEVRTGPKPPKPSLSSSRIKKVSYNIGTMFLRETSL

SEQ ID NO: 48584 - protein, 732 aa, Homo sapiens
MSRRKISSESFSSLGSDYLETSPEEEGECPLSRLCWNGSRSPPGPLEPSPAAAAAAAAPAPTPAASAAAAAATAGARRVQRRRRVNLDSLGESISRLTAPSPQTIQQTLKRTLQYYEHQVIGYRDAEKNFHNISNRCSYADHSNKEEIEDVSGILQCTANILGLKFEEIQKRFGEEFFNICFHENERVLRAVGGTLQDFFNGFDALLEHIRTSFGKQATLESPSFLCKELPEGTLMLHYFHPHHIVGFAMLGMIKAAGKKIYRLDVEVEQVANEKLCSDVSNPGNCSCLTFLIKECENTNIMKNLPQGTSQVPADLRISINTFCRAFPFHLMFDPSMSVLQLGEGLRKQLRCDTHKVLKFEDCFEIVSPKVNATFERVLLRLSTPFVIRTKPEASGSENKDKVMEVKGQMIHVPESNSILFLGSPCVDKLDELMGRGLHLSDIPIHDATRDVILVGEQAKAQDGLKKRMDKLKATLERTHQALEEEKKKTVDLLYSIFPGDVAQQLWQGQQVQARKFDDVTMLFSDIVGFTAICAQCTPMQVISMLNELYTRFDHQCGFLDIYKVETIGDAYCVAAGLHRKSLCHAKPIALMALKMMELSEEVLTPDGRPIQMRIGIHSGSVLAGVVGVRMPRYCLFGNNVTLASKFESGSHPRRINVSPTTYQLLKREESFTFIPRSREELPDNFPKEIPGICYFLEVRTGPKPPKPSLSSSRIKKVSYNIGTMFLRETSL

SEQ ID NO: 48585 - protein, 690 aa, Homo sapiens
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYRLLKDCPGFVFTPRSREELPPNFPSEIPGICHFLDAYQQGTNSKPCFQKKDVEDGNANFLGKASGID

SEQ ID NO: 48586 - protein, 690 aa, Homo sapiens; identical to SEQ ID NO: 48585

SEQ ID NO: 48587 - protein, 690 aa, Homo sapiens; identical to SEQ ID NO: 48585

SEQ ID NO: 48588 - protein, 690 aa, Homo sapiens; identical to SEQ ID NO: 48585

SEQ ID NO: 48589 - protein, 690 aa, Homo sapiens; identical to SEQ ID NO: 48585

SEQ ID NO: 48590 - protein, 619 aa, Homo sapiens
MYGFVNHALELLVIRNYGPEVWEDIKKEAQLDEEGQFLVRIIYDDSKTYDLVAAASKVLNLNAGEILQMFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 48591 - protein, 551 aa, Homo sapiens
MFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 48592 - protein, 599 aa, Homo sapiens
MLMCFIKEAQLDEEGQFLVRIIYDDSKTYDLVAAASKVLNLNAGEILQMFGKMFFVFCQESGYDTILRVLGSNVREFLQNLDALHDHLATIYPGMRAPSFRCTDAEKGKGLILHYYSEREGLQDIVIGIIKTVAQQIHGTEIDMKVIQQRNEECDHTQFLIEEKESKEEDFYEDLDRFEENGTQESRISPYTFCKAFPFHIIFDRDLVVTQCGNAIYRVLPQLQPGNCSLLSVFSLVRPHIDISFHGILSHINTVFVLRSKEGLLDVEKLECEDELTGTEISCLRLKGQMIYLPEADSILFLCSPSVMNLDDLTRRGLYLSDIPLHDATRDLVLLGEQFREEYKLTQELEILTDRLQLTLRALEDEKKKTDTLLYSVLPPSVANELRHKRPVPAKRYDNVTILFSGIVGFNAFCSKHASGEGAMKIVNLLNDLYTRFDTLTDSRKNPFVYKVETVGDKYMTVSGLPEPCIHHARSICHLALDMMEIAGQVQVDGESVQITIGIHTGEVVTGVIGQRMPRYCLFGNTVNLTSRTETTGEKGKINVSEYTYRCLMSPENSDPQFHLEHRGPVSMKGKKEPMQVWFLSRKNTGTEETKQDDD

SEQ ID NO: 48593 - protein, 551 aa, Homo sapiens; identical to SEQ ID NO: 48591

SEQ ID NO: 48594 - protein, 1073 aa, Homo sapiens
MKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 48595 - protein, 1103 aa, Homo sapiens
MTACARRAGGLPDPGLCGPAWWAPSLPRLPRALPRLPLLLLLLLLQPPALSAVFTVGVLGPWACDPIFSRARPDLAARLAAARLNRDPGLAGGPRFEVALLPEPCRTPGSLGAVSSALARVSGLVGPVNPAACRPAELLAEEAGIALVPWGCPWTQAEGTTAPAVTPAADALYALLRAFGWARVALVTAPQDLWVEAGRSLSTALRARGLPVASVTSMEPLDLSGAREALRKVRDGPRVTAVIMVMHSVLLGGEEQRYLLEAAEELGLTDGSLVFLPFDTIHYALSPGPEALAALANSSQLRRAHDAVLTLTRHCPSEGSVLDSLRRAQERRELPSDLNLQQVSPLFGTIYDAVFLLARGVAEARAAAGGRWVSGAAVARHIRDAQVPGFCGDLGGDEEPPFVLLDTDAAGDRLFATYMLDPARGSFLSAGTRMHFPRGGSAPGPDPSCWFDPNNICGGGLEPGLVFLGFLLVVGMGLAGAFLAHYVRHRLLHMQMVSGPNKIILTVDDITFLHPHGGTSRKVAQGSRSSLGARSMSDIRSGPSQHLDSPNIGVYEGDRVWLKKFPGDQHIAIRPATKTAFSKLQELRHENVALYLGLFLARGAEGPAALWEGNLAVVSEHCTRGSLQDLLAQREIKLDWMFKSSLLLDLIKGIRYLHHRGVAHGRLKSRNCIVDGRFVLKITDHGHGRLLEAQKVLPEPPRAEDQLWTAPELLRDPALERRGTLAGDVFSLAIIMQEVVCRSAPYAMLELTPEEVVQRVRSPPPLCRPLVSMDQAPVECILLMKQCWAEQPELRPSMDHTFDLFKNINKGRKTNIIDSMLRMLEQYSSNLEDLIRERTEELELEKQKTDRLLTQMLPPSVAEALKTGTPVEPEYFEQVTLYFSDIVGFTTISAMSEPIEVVDLLNDLYTLFDAIIGSHDVYKVETIGDAYMVASGLPQRNGQRHAAEIANMSLDILSAVGTFRMRHMPEVPVRIRIGLHSGPCVAGVVGLTMPRYCLFGDTVNTASRMESTGLPYRIHVNLSTVGILRALDSGYQVELRGRTELKGKGAEDTFWLVGRRGFNKPIPKPPDLQPGSSNHGISLQEIPPERRRKLEKARPGQFS

SEQ ID NO: 48596 - protein, 1108 aa, Homo sapiens
MFLGLGRFSRLVLWFAAFRKLLGHHGLASAKFLWCLCLLSVMSLPQQVWTLPYKIGVVGPWACDSLFSKALPEVAARLAIERINRDPSFDLSYSFEYVILNEDCQTSRALSSFISHHQMASGFIGPTNPGYCEAASLLGNSWDKGIFSWACVNYELDNKISYPTFSRTLPSPIRVLVTVMKYFQWAHAGVISSDEDIWVHTANRVASALRSHGLPVGVVLTTGQDSQSMRKALQRIHQADRIRIIIMCMHSALIGGETQMHLLECAHDLKMTDGTYVFVPYDALLYSLPYKHTPYRVLRNNPKLREAYDAVLTITVESQEKTFYQAFTEAAARGEIPEKLEFDQVSPLFGTIYNSIYFIAQAMNNAMKENGQAGAASLVQHSRNMQFHGFNQLMRTDSNGNGISEYVILDTNLKEWELHSTYTVDMEMELLRFGGTPIHFPGGRPPRADAKCWFAEGKICHGGIDPAFAMMVCLTLLIALLSINGFAYFIRRRINKIQLIKGPNRILLTLEDVTFINPHFGSKRGSRASVSFQITSEVQSGRSPRLSFSSGSLTPATYENSNIAIYEGDWVWLKKFSLGDFGDLKSIKSRASDVFEMMKDLRHENINPLLGFFYDSGMFAIVTEFCSRGSLEDILTNQDVKLDWMFKSSLLLDLIKGMKYLHHREFVHGRLKSRNCVVDGRFVLKVTDYGFNDILEMLRLSEEESSMEELLWTAPELLRAPRGSRLGSFAGDVYSFAIIMQEVMVRGTPFCMMDLPAQEIINRLKKPPPVYRPVVPPEHAPPECLQLMKQCWAEAAEQRPTFDEIFNQFKTFNKGKKTNIIDSMLRMLEQYSSNLEDLIRERTEELEIEKQKTEKLLTQMLPPSVAESLKKGCTVEPEGFDLVTLYFSDIVGFTTISAMSEPIEVVDLLNDLYTLFDAIIGSHDVYKVETIGDAYMVASGLPKRNGSRHAAEIANMSLDILSSVGTFKMRHMPEVPVRIRIGLHSGPVVAGVVGLTMPRYCLFGDTVNTASRMESTGLPYRIHVSLSTVTILQNLSEGYEVELRGRTELKGKGTEETFWLIGKKGFMKPLPVPPPVDKDGQVGHGLQPVEIAAFQRRKAERQLVRNKP

SEQ ID NO: 48597 - protein, 201 aa, Homo sapiens
MGNVMEGKSVEELSSTECHQWYKKFMTECPSGQLTLYEFRQFFGLKNLSPSASQYVEQMFETFDFNKDGYIDFMEYVAALSLVLKGKVEQKLRWYFKLYDVDGNGCIDRDELLTIIQAIRAINPCSDTTMTAEEFTDTVFSKIDVNGDGELSLEEFIEGVQKDQMLLDTLTRSLDLTRIVRRLQNGEQDEEGADEAAEAAG

SEQ ID NO: 48598 - protein, 201 aa, Homo sapiens; identical to SEQ ID NO: 48597

SEQ ID NO: 48599 - protein, 205 aa, Homo sapiens
MEGKSVEELSSTECHQWYKKFMTECPSGQLTLYEFRQFFGLKNLSPSASQYVEQMFETFDFNKDGYIDFMEYVAALSLVLKGKVEQKLRWYFKLYDVDGNGCIDRDELLTIIQFPHQYQKTAIRAINPCSDTTMTAEEFTDTVFSKIDVNGDGELSLEEFIEGVQKDQMLLDTLTRSLDLTRIVRRLQNGEQDEEGADEAAEAAG

SEQ ID NO: 48600 - protein, 201 aa, Homo sapiens; identical to SEQ ID NO: 48597

SEQ ID NO: 48601 - protein, 88 aa, Homo sapiens
MGNVMEGKSVEELSSTECHQWYKKFMTECPSGQLTLYEFRQFFGLKNLSPSASQYVEQMFETFDFNKDGYIDFMEYVAALSLVLKGKV

SEQ ID NO: 48602 - protein, 201 aa, Homo sapiens; identical to SEQ ID NO: 48597

SEQ ID NO: 48603 - protein, 200 aa, Homo sapiens
MGQEFSWEEAEAAGEIDVAELQEWYKKFVMECPSGTLFMHEFKRFFKVTDDEEASQYVEGMFRAFDKNGDNTIDFLEYVAALNLVLRGTLEHKLKWTFKIYDKDGNGCIDRLELLNIVEGIYQLKKACRRELQTEQGQLLTPEEVVDRIFLLVDENGDGQLSLNEFVEGARRDKWVMKMLQMDMNPSSWLAQQRRKSAMF

SEQ ID NO: 48604 - protein, 172 aa, Homo sapiens
MGQEFSWEEAEAAGEIDVAELQEWYKKFVMECPSGTLFMHEFKRFFKVTDDEEASQYVEGMFRAFDKNGDNTIDFLEYVAALNLVLRGTLEHKLKWTFKIYDKDGNGCIDRLELLNIVECRRELQTEQGQLLTPEEVVDRIFLLVDENGDGQLSLNEFVEGARRDNLLMPTL

SEQ ID NO: 48605 - protein, 209 aa, Homo sapiens
MGNGKSIAGDQKAVPTQETHVWYRTFMMEYPSGLQTLHEFKTLLGLQGLNQKANKHIDQVYNTFDTNKDGFVDFLEFIAAVNLIMQEKMEQKLKWYFKLYDADGNGSIDKNELLDMFMAVQALNGQQTLSPEEFINLVFHKIDINNDGELTLEEFINGMAKDQDLLEIVYKSFDFSNVLRVICNGKQPDMETDSSKSPDKAGLGKVKMK

SEQ ID NO: 48606 - protein, 196 aa, Homo sapiens
MGNGKSIAGDQKAVPTQETHVWYRTFMMEYPSGLQTLHEFKTLLGLQGLNQKANKHIDQVYNTFDTNKDGFVDFLEFIAAVNLIMQEKMEQKLKWYFKLYDADGNGSIDKNELLDMFMAVQALNGQQTLSPEEFINLVFHKIDINNDGNGATLYWITFPTKGIDFRRIYQWHGKRSGSPGDCLQELRLLQCAESNL

SEQ ID NO: 48607 - protein, 115 aa, Homo sapiens
MNAFLLSALCLLGAWAALAGGVTVQDGNFSFSLESVKKLKDLQEPQEPRVGKLRNFAPIPGEPVVPILCSNPNFPEELKPLCKEPNAQEILQRLEEIAEDPGTCEICAYAACTGC

SEQ ID NO: 48608 - protein, 112 aa, Homo sapiens
MGCRAASGLLPGVAVVLLLLLQSTQSVYIQYQGFRVQLESMKKLSDLEAQWAPSPRLQAQSLLPAVCHHPALPQDLQPVCASQEASSIFKTLRTIANDDCELCVNVACTGCL

SEQ ID NO: 48609 - protein, 197 aa, Homo sapiens
MSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTGA

SEQ ID NO: 48610 - protein, 197 aa, Homo sapiens; identical to SEQ ID NO: 48609

SEQ ID NO: 48611 - protein, 197 aa, Homo sapiens; identical to SEQ ID NO: 48609

SEQ ID NO: 48612 - protein, 199 aa, Homo sapiens
MSGPRPVVLSGPSGAGKSTLLKRLLQEHSGIFGFSVSRESRALVEGYHEEPEARRGERQREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTGA

SEQ ID NO: 48613 - protein, 242 aa, Homo sapiens
MSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLRLRQRNTETEESLVKRLAAAQADMESSKEPGLFDVVIINDSLDQAYAELKEALSEVGPSLCLPGQGPRGGLGARPLLSMRPLRKSRKLKGPAPEACCLFSAPRAHTGPGQQH

SEQ ID NO: 48614 - protein, 218 aa, Homo sapiens
MLRRPLAGLAAAALGRAPPDGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSPAGLESCPTAAVRTAAGQSPACLMWSSLTTAWTRPTQS

SEQ ID NO: 48615 - protein, 197 aa, Homo sapiens; identical to SEQ ID NO: 48609

SEQ ID NO: 48616 - protein, 241 aa, Homo sapiens
MLRRPLAGLAAAALGRAPPDGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESRNQESSKDRRLRLAVCSRHPGPIQDQGSSIEPPPWQAIRQLCALGQHVEWRRCCPCGWNILG

SEQ ID NO: 48617 - protein, 197 aa, Homo sapiens; identical to SEQ ID NO: 48609

SEQ ID NO: 48618 - protein, 218 aa, Homo sapiens
MLRRPLAGLAAAALGRAPPDGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTGA

SEQ ID NO: 48619 - protein, 253 aa, Homo sapiens
MAGSQKEEIMPPQQGVPFQESGCWGSMGAQSRERSGRDHSGTWICAGGSQETFHLGAPVETTCLAGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSE

SEQ ID NO: 48620 - protein, 171 aa, Homo sapiens
MSGPRPVVLSGPSGAGKSTLLKRLLQEHSGIFGFSVSRESNTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESEIKKAQRTGA

SEQ ID NO: 48621 - protein, 272 aa, Homo sapiens
MAGSQKEEIMPPQQGVPFQESGCWGSMGAQSRERSGRDHSGTWICAGGSQETFHLGAPVETTCLAASLLTPRHVGPQACGAERAFGSWEEHPAEEAAPGAQRHLWLQRVPYHEEPEARRGERQREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESRNQESSKDRRLRLAVCSRHPGPIQDQGSSIEPPPWQAIRQLCALGQHV

SEQ ID NO: 48622 - protein, 217 aa, Homo sapiens
MLRRPLAGLAAAALGRAPPDGMSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSKEPGLFDVVIINDSLDQAYAELKEALSEEIKKAQRTG

SEQ ID NO: 48623 - protein, 304 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 48624 - protein, 304 aa, Homo sapiens; identical to SEQ ID NO: 48623

SEQ ID NO: 48625 - protein, 304 aa, Homo sapiens; identical to SEQ ID NO: 48623

SEQ ID NO: 48626 - protein, 167 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCVSIPDVVGWFVLFYKPGIVLLLALAKYLKMNNFL

SEQ ID NO: 48627 - protein, 304 aa, Homo sapiens; identical to SEQ ID NO: 48623

SEQ ID NO: 48628 - protein, 68 aa, Homo sapiens
MNRAFSRKKDKTWMHTPEALSKHFIPYNAKFLGSTEVEQPKGTEVVRDAVRKLKFARHIKKSEGQKIP

SEQ ID NO: 48629 - protein, 167 aa, Homo sapiens; identical to SEQ ID NO: 48626

SEQ ID NO: 48630 - protein, 194 aa, Homo sapiens
MTENSTSAPAAKPKRAKASKKSTDHPKYSDMIVAAIQAEKNRAGSSRQSIQKYIKSHYKVGENADSQIKLSIKRLVTTGVLKQTKGVGASGSFRLAKSDEPKKSVAFKKTKKEIKKVATPKKASKPKKAASKAPTKKPKATPVKKAKKKLAATPKKAKKPKTVKAKPVKASKPKKAKPVKPKAKSSAKRAGKKK

SEQ ID NO: 48631 - protein, 177 aa, Homo sapiens
MTEKSTDHPKYSDMIVAAIQAEKNRAGSSRQSIQKYIKSHYKVGENADSQIKLSIKRLVTTGVLKQTKGVGASGSFRLAKSDEPKKSVAFKKTKKEIKKVATPKKASKPKKAASKAPTKKPKATPVKKAKKKLAATPKKAKKPKTVKAKPVKASKPKKAKPVKPKAKSSAKRAGKKK

SEQ ID NO: 48632 - protein, 136 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 48633 - protein, 123 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAAIGALQVKWWVGRLRVCIPVVYQEQFQIVACAYII

SEQ ID NO: 48634 - protein, 136 aa, Homo sapiens; identical to SEQ ID NO: 48632

SEQ ID NO: 48635 - protein, 136 aa, Homo sapiens; identical to SEQ ID NO: 48632

SEQ ID NO: 48636 - protein, 136 aa, Homo sapiens; identical to SEQ ID NO: 48632

SEQ ID NO: 48637 - protein, 348 aa, Homo sapiens
MPDELTEPGRATPARASSFLIENLLAAEAKGAGRATQGDGSREDEEEDDDDPEDEDAEQARRRRLQRRRQLLAGTGPGGEARARALLGPGALGLGPRPPPGPGPPFALGCGGAARWYPRAHGGYGGGLSPDTSDRDSPETGEEMGRAEGAWPRGPGPGAVQREAAELAARGPAAGTEEASELAEVPAAAGETRGGVGVGGGRKKKTRTVFSRSQVFQLESTFDLKRYLSSAERAGLAASLQLTETQVKIWFQNRRNKWKRQLAAELEAASLSPPGAQRLVRVPVLYHESPPAAAAAGPPATLPFPLAPAAPAPPPPLLGFSGALAYPLAAFPAAASVPFLRAQMPGLV

SEQ ID NO: 48638 - protein, 273 aa, Homo sapiens
MGSKEDAGKGCPAAGGVSSFTIQSILGGGPSEAPREPVGWPARKRSLSVSSEEEEPDDGWKAPACFCPDQHGPKEQGPKHHPPIPFPCLGTPKGSGGSGPGGLERTPFLSPSHSDFKEEKERLLPAGSPSPGSERPRDGGAERQAGAAKKKTRTVFSRSQVYQLESTFDMKRYLSSSERACLASSLQLTETQVKTWFQNRRNKWKRQLSAELEAANMAHASAQTLVSMPLVFRDSSLLRVPVPRSLAFPAPLYYPGSNLSALPLYNLYNKLDY

SEQ ID NO: 48639 - protein, 357 aa, Homo sapiens
MPEPGPDAAGTASAQPQPPPPPPPAPKESPFSIKNLLNGDHHRPPPKPQPPPRTLFAPASAAAAAAAAAAAAAKGALEGAAGFALSQVGDLAFPRFEIPAQRFALPAHYLERSPAWWYPYTLTPAGGHLPRPEASEKALLRDSSPASGTDRDSPEPLLKADPDHKELDSKSPDEIILEESDSEESKKEGEAAPGAAGASVGAAAATPGAEDWKKGAESPEKKPACRKKKTRTVFSRSQVFQLESTFDMKRYLSSSERAGLAASLHLTETQVKIWFQNRRNKWKRQLAAELEAANLSHAAAQRIVRVPILYHENSAAEGAAAAAAGAPVPVSQPLLTFPHPVYYSHPVVSSVPLLRPV

SEQ ID NO: 48640 - protein, 1134 aa, Homo sapiens
MESTPSFLKGTPTWEKTAPENGIVRQEPGSPPRDGLHHGPLCLGEPAPFWRGVLSTPDSWLPPGFPQGPKDMLPLVEGEGPQNGERKVNWLGSKEGLRWKEAMLTHPLAFCGPACPPRCGPLMPEHSGGHLKSDPVAFRPWHCPFLLETKILERAPFWVPTCLPPYLVSGLPPEHPCDWPLTPHPWVYSGGQPKVPSAFSLGSKGFYYKDPSIPRLAKEPLAAAEPGLFGLNSGGHLQRAGEAERPSLHQRDGEMGAGRQQNPCPLFLGQPDTVPWTSWPACPPGLVHTLGNVWAGPGDGNLGYQLGPPATPRCPSPEPPVTQRGCCSSYPPTKGGGLGPCGKCQEGLEGGASGASEPSEEVNKASGPRACPPSHHTKLKKTWLTRHSEQFECPRGCPEVEERPVARLRALKRAGSPEVQGAMGSPAPKRPPDPFPGTAEQGAGGWQEVRDTSIGNKDVDSGQHDEQKGPQDGQASLQDPGLQDIPCLALPAKLAQCQSCAQAAGEGGGHACHSQQVRRSPLGGELQQEEDTATNSSSEEGPGSGPDSRLSTGLAKHLLSGLGDRLCRLLRREREALAWAQREGQGPAVTEDSPGIPRCCSRCHHGLFNTHWRCPRCSHRLCVACGRVAGTGRAREKAGFQEQSAEECTQEAGHAACSLMLTQFVSSQALAELSTAMHQVWVKFDIRGHCPCQADARVWAPGDAGQQKESTQKTPPTPQPSCNGDTHRTKSIKEETPDSAETPAEDRAGRGPLPCPSLCELLASTAVKLCLGHERIHMAFAPVTPALPSDDRITNILDSIIAQVVERKIQEKALGPGLRAGPGLRKGLGLPLSPVRPRLPPPGALLWLQEPQPCPRRGFHLFQEHWRQGQPVLVSGIQRTLQGNLWGTEALGALGGQVQALSPLGPPQPSSLGSTTFWEGFSWPELRPKSDEGSVLLLHRALGDEDTSRVENLAASLPLPEYCALHGKLNLASYLPPGLALRPLEPQLWAAYGVSPHRGHLGTKNLCVEVADLVSILVHADTPLPAWHRAQKDFLSGLDGEGLWSPGSQVSTVWHVFRAQDAQRIRRFLQMVQGLVSTVSVTQHFLSPETSALSAQLCHQGPSLPPDCHLLYAQMDWAVFQAVKVAVGTLQEAK

SEQ ID NO: 48641 - protein, 1189 aa, Homo sapiens
MESTPSFLKGTPTWEKTAPENGIVRQEPGSPPRDGLHHGPLCLGEPAPFWRGVLSTPDSWLPPGFPQGPKDMLPLVEGEGPQNGERKVNWLGSKEGLRWKEAMLTHPLAFCGPACPPRCGPLMPEHSGGHLKSDPVAFRPWHCPFLLETKILERAPFWVPTCLPPYLVSGLPPEHPCDWPLTPHPWVYSGGQPKVPSAFSLGSKGFYYKDPSIPRLAKEPLAAAEPGLFGLNSGGHLQRAGEAERPSLHQRDGEMGAGRQQNPCPLFLGQPDTVPWTSWPACPPGLVHTLGNVWAGPGDGNLGYQLGPPATPRCPSPEPPVTQRGCCSSYPPTKGGGLGPCGKCQEGLEGGASGASEPSEEVNKASGPRACPPSHHTKLKKTWLTRHSEQFECPRGCPEVEERPVARLRALKRAGSPEVQGAMGSPAPKRPPDPFPGTAEQGAGGWQEVRDTSIGNKDVDSGQHDEQKGPQDGQASLQDPGLQDIPCLALPAKLAQCQSCAQAAGEGGGHACHSQQVRRSPLGGELQQEEDTATNSSSEEGPGSGPDSRLSTGLAKHLLSGLGDRLCRLLRREREALAWAQREGQGPAVTEDSPGIPRCCSRCHHGLFNTHWRCPRCSHRLCVACGRVAGTGRAREKAGFQEQSAEECTQEAGHAACSLMLTQFVSSQALAELSTAMHQVWVKFDIRGHCPCQADARVWAPGDAGQQKESTQKTPPTPQPSCNGDTHRTKSIKEETPDSAETPAEDRAGRGPLPCPSLCELLASTAVKLCLGHERIHMAFAPVTPALPSDDRITNILDSIIAQVVERKIQEKALGPGLRAGPGLRKGLGLPLSPVRPRLPPPGALLWLQEPQPCPRRGFHLFQEHWRQGQPVLVSGIQRTLQGNLWGTEALGALGGQVQALSPLGPPQPSSLGSTTFWEGFSWPELRPKSDEGSVLLLHRALGDEDTSRVENLAASLPLPEYCALHGKLNLASYLPPGLALRPLEPQLWAAYGVSPHRGHLGTKNLCVEVADLVSILVHADTPLPAWHRAQKDFLSGLDGEGLWSPGSQVSTVWHVFRAQDAQRIRRFLQMVCPAGAGALEPGAPGSCYLDAGLRRRLREEWGVSCWTLLQAPGEAVLVPAGAPHQVQGLVSTVSVTQHFLSPETSALSAQLCHQGPSLPPDCHLLYAQMDWAVFQAVKVAVGTLQEAK

SEQ ID NO: 48642 - protein, 280 aa, Homo sapiens
MPADIMEKNSSSPVAATPASVNTTPDKPKTASEHRKSSKPIMEKRRRARINESLSQLKTLILDALKKDSSRHSKLEKADILEMTVKHLRNLQRAQMTAALSTDPSVLGKYRAGFSECMNEVTRFLSTCEGVNTEVRTRLLGHLANCMTQINAMTYPGQPHPALQAPPPPPPGPGGPQHAPFAPPPPLVPIPGGAAPPPGGAPCKLGSQAGEAAKVFGGFQVVPAPDGQFAFLIPNGAFAHSGPVIPVYTSNSGTSVGPNAVSPSSGPSLTADSMWRPWRN

SEQ ID NO: 48643 - protein, 173 aa, Homo sapiens
MGLPRRAGDAAELRKSLKPLLEKRRRARINQSLSQLKGLILPLLGRENSNCSKLEKADVLEMTVRFLQELPASSWPTAAPLPCDSYREGYSACVARLARVLPACRVLEPAVSARLLEHLWRRAASATLDGGRAGDSSGPSAPAPAPASAPEPASAPVPSPPSPPCGPGLWRPW

SEQ ID NO: 48644 - protein, 76 aa, Homo sapiens
MGLPRRAGDAAELRKSLKPLLEKRRRARINQSLSQLKGLILPLLGREDASGWHTWLPLHAQNCFLLYIQAPEQPPA

SEQ ID NO: 48645 - protein, 76 aa, Homo sapiens; identical to SEQ ID NO: 48644

SEQ ID NO: 48646 - protein, 186 aa, Homo sapiens
MEKKRRARINVSLEQLKSLLEKHYSHQIRKRKLEKADILELSVKYMRSLQNSLQGLWPVPRGAEQPSGFRSCLPGVSQLLRRGDEVGSGLRCPLVPESAAGSTMDSAGLGQEAPALFRPCTPAVWAPAPAAGGPRSPPPLLLLPESLPGSSASVPPPQPASSRCAESPGLGLRVWRPWGSPGDDLN

SEQ ID NO: 48647 - protein, 221 aa, Homo sapiens
MAADTPGKPSASPMAGAPASASRTPDKPRSAAEHRKSSKPVMEKRRRARINESLAQLKTLILDALRKESSRHSKLEKADILEMTVRHLRSLRRVQVTAALSADPAVLGKYRAGFHECLAEVNRFLAGCEGVPADVRSRLLGHLAACLRQLGPSRRPASLSPAAPAEAPAPEVYAGRPLLPSLGGPFPLLAPPLLPGLTRALPAAPRAGPQGPGGPWRPWLR

SEQ ID NO: 48648 - protein, 247 aa, Homo sapiens
MAADTPGKPSASPMAGAPASASRTPDKPRSAAEHRKVGSRPGVRGATGGREGRGTQPVPDPQSSKPVMEKRRRARINESLAQLKTLILDALRKESSRHSKLEKADILEMTVRHLRSLRRVQVTAALSADPAVLGKYRAGFHECLAEVNRFLAGCEGVPADVRSRLLGHLAACLRQLGPSRRPASLSPAAPAEAPAPEVYAGRPLLPSLGGPFPLLAPPLLPGLTRALPAAPRAGPQGPGGPWRPWLR

SEQ ID NO: 48649 - protein, 166 aa, Homo sapiens
MAPSTVAVELLSPKEKNRLRKPVVEKMRRDRINSSIEQLKLLLEQEFARHQPNSKLEKADILEMAVSYLKHSKAFVAAAGPKSLHQDYSEGYSWCLQEAVQFLTLHAASDTQMKLLYHFQRPPAAPAAPAKEPKAPGAAPPPALSAKATAAAAAAHQPACGLWRPW

SEQ ID NO: 48650 - protein, 224 aa, Homo sapiens
MAPPAAPGRDRVGREDEDGWETRGDRKARKPLVEKKRRARINESLQELRLLLAGAEVQAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 48651 - protein, 214 aa, Homo sapiens
MAPPAAPGRDRVGREDEDGWETRGDRKARKPLVEKKRRARINESLQELRLLLAGAEVQAKLENAEVLELTVRRVQGVLRGRARGEWRRGGRGRRPRAPVTPARRRTSLPAPLSCRRRGLPPEQGAPPRLLGEPRPRGPGGLGHAVAAHRAGRGSLPPTLGPRARAAAGGSERALRCRLHPVHARGAHVRVHVPGHRRYRRCRAPEPSARVHAAA

SEQ ID NO: 48652 - protein, 222 aa, Homo sapiens
MAPPAAPGRDRVGREDEDGWETRGDRKARKPLVEKKRRARINESLQELRLLLAGAEAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 48653 - protein, 225 aa, Homo sapiens
MVTRDRAENRDGPKMLKPLVEKRRRDRINRSLEELRLLLLERTRDQNLRNPKLEKAEILEFAVGYLRERSRVEPPGVPRSPVQDAEALASCYLSGFRECLLRLAAFAHDASPAARAQLFSALHGYLRPKPPRPKPVDPRPPAPRPSLDPAAPALGPALHQRPPVHQGHPSPRCAWSPSLCSPRAGDSGAPAPLTGLLPPPPPPHRQDGAPKAPLPPPPAFWRPWP

SEQ ID NO: 48654 - protein, 230 aa, Homo sapiens
MVTRDRAENRDGPKMLKPLVEKRRRDRINRSLEELRLLLLERTRDQNLRNPKLEKAEILEFAVGYLRERSRVEPPAAAAPGVPRSPVQDAEALASCYLSGFRECLLRLAAFAHDASPAARAQLFSALHGYLRPKPPRPKPVDPRPPAPRPSLDPAAPALGPALHQRPPVHQGHPSPRCAWSPSLCSPRAGDSGAPAPLTGLLPPPPPPHRQDGAPKAPLPPPPAFWRPWP

SEQ ID NO: 48655 - protein, 337 aa, Homo sapiens
MKRPCEETTSESDMDETIDVGSENNYSGQSTSSVIRLNSPTTTSQIMARKKRRGIIEKRRRDRINNSLSELRRLVPTAFEKQGSAKLEKAEILQMTVDHLKMLQATGGKGYFDAHALAMDFMSIGFRECLTEVARYLSSVEGLDSSDPLRVRLVSHLSTCATQREAAAMTSSMAHHHHPLHPHHWAAAFHHLPAALLQPNGLHASESTPCRLSTTSEVPPAHGSALLTATFAHADSALRMPSTGSVAPCVPPLSTSLLSLSATVHAAAAAATAAAHSFPLSFAGAFPMLPPNAAAAVAAATAISPPLSVSATSSPQQTSSGTNNKPYRPWGTEVGAF

SEQ ID NO: 48656 - protein, 291 aa, Homo sapiens
MARKKRRGIIEKRRRDRINNSLSELRRLVPTAFEKQGSAKLEKAEILQMTVDHLKMLQATGGKGYFDAHALAMDFMSIGFRECLTEVARYLSSVEGLDSSDPLRVRLVSHLSTCATQREAAAMTSSMAHHHHPLHPHHWAAAFHHLPAALLQPNGLHASESTPCRLSTTSEVPPAHGSALLTATFAHADSALRMPSTGSVAPCVPPLSTSLLSLSATVHAAAAAATAAAHSFPLSFAGAFPMLPPNAAAAVAAATAISPPLSVSATSSPQQTSSGTNNKPYRPWGTEVGAF

SEQ ID NO: 48657 - protein, 406 aa, Homo sapiens
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 48658 - protein, 382 aa, Homo sapiens
VYACVCVCVYMHVCVDACMCCEAGRLAFHSSLSSLCSALGAVIALLLWGQLFAVDSGNDVTDIADDGCPKPPEIAHGYVEHSVRYQCKNYYKLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 48659 - protein, 347 aa, Homo sapiens
MSALGAVIALLLWGQLFAVDSGNDVTDIADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 48660 - protein, 281 aa, Homo sapiens
MSRISQMTAARSPPRLHMAMWSTRFATSVRTNPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 48661 - protein, 385 aa, Homo sapiens
MHVCVCVCVCVYMPVCVDACMCCEAGRPAFRSFLFSLCSDLGAVISLLLWGRQLFALYSGNDVTDISDDRFPKPPEIANGYVEHLFRYQCKNYYRLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQHWVQKTIAEN

SEQ ID NO: 48662 - protein, 348 aa, Homo sapiens
MSDLGAVISLLLWGRQLFALYSGNDVTDISDDRFPKPPEIANGYVEHLFRYQCKNYYRLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQHWVQKTIAEN

SEQ ID NO: 48663 - protein, 348 aa, Homo sapiens; identical to SEQ ID NO: 48662

SEQ ID NO: 48664 - protein, 204 aa, Homo sapiens
MAAANPWDPASAPNGAGLVLGHFIASGMVNQKNLEIELLKLEKDTADVVHPFFLAQKCHTLQSMNNHLEAVLKEKRSLRQRLLKPMCQENLPIEAVYHRYMVHLLELAVTFIERLETHLETIRNIPHLAANLKKMNQALAKMDILVTETEELAENILKWRKQQNEVSSCIPKILAEESYLYKHDIIMPPLPFTSKVHVQTINAK

SEQ ID NO: 48665 - protein, 278 aa, Homo sapiens
MEPQEERETQVAAWLKKIFGDHPIPQYEVNPRTTEILHHLSERNRVRDRDVYLVIEDLKQKASEYESEAKYLQDLLMESVNFSPANLSSTGSRYLNALVDSAVALETKDTSLASFIPAVNDLTSDLFRTKSKSEEIKIELEKLEKNLTATLVLEKCLQEDVKKAELHLSTERAKVDNRRQNMDFLKAKSEEFRFGIKAAEEQLSARGMDASLSHQSLVALSEKLARLKQQTIPLKKKLESYLDLMPNPSLAQVKIEEAKRELDSIEAELTRRVDMMEL

SEQ ID NO: 48666 - protein, 235 aa, Homo sapiens
MAAANPWDPASAPNGAGLVLGHFIASGMVNQEMLNMSKKTVSCFVNFTRLQQITNIQAEIYQKNLEIELLKLEKDTADVVHPFFLAQKCHTLQSMNNHLEAVLKEKRSLRQRLLKPMCQENLPIEAVYHRYMVHLLELAVTFIERLETHLETIRNIPHLAANLKKMNQALAKMDILVTETEELAENILKWRKQQNEVSSCIPKILAEESYLYKHDIIMPPLPFTSKVHVQTINAK

SEQ ID NO: 48667 - protein, 204 aa, Homo sapiens; identical to SEQ ID NO: 48664

SEQ ID NO: 48668 - protein, 603 aa, Homo sapiens
MSCGNEFVETLKKIGYPKADNLNGEDFDWLFEGVEDESFLKWFCGNVNEQNVLSERELEAFSILQKSGKPILEGAALDEALKTCKTSDLKTPRLDDKELEKLEDEVQTLLKLKNLKIQRRNKCQLMASVTSHKSLRLNAKEEEATKKLKQSQGILNAMITKISNELQALTDEVTQLMMFFRHSNLGQGTNPLVFLSQFSLEKYLSQEEQSTAALTLYTKKQFFQGIHEVVESSNEDNFQLLDIQTPSICDNQEILEERRLEMARLQLAYICAQHQLIHLKASNSSMKSSIKWAEESLHSLTSKAVDKENLDAKISSLTSEIMKLEKEVTQIKDRSLPAVVRENAQLLNMPVVKGDFDLQIAKQDYYTARQELVLNQLIKQKASFELLQLSYEIELRKHRDIYRQLENLVQELSQSNMMLYKQLEMLTDPSVSQQINPRNTIDTKDYSTHRLYQVLEGENKKKELFLTHGNLEEVAEKLKQNISLVQDQLAVSAQEHSFFLSKRNKDVDMLCDTLYQGGNQLLLSDQELTEQFHKVESQLNKLNHLLTDILADVKTKRKTLANNKLHQMEREFYVYFLKDEDYLKDIVENLETQSKIKAVSLED

SEQ ID NO: 48669 - protein, 603 aa, Homo sapiens; identical to SEQ ID NO: 48668

SEQ ID NO: 48670 - protein, 10 aa, Homo sapiens
MSCGNEFVET

SEQ ID NO: 48671 - protein, 33 aa, Homo sapiens
MSCGNEFVETLKKIGYPKADNLNGEDFDWLFEG

SEQ ID NO: 48672 - protein, 363 aa, Homo sapiens
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 48673 - protein, 318 aa, Homo sapiens
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 48674 - protein, 237 aa, Homo sapiens
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 48675 - protein, 237 aa, Homo sapiens; identical to SEQ ID NO: 48674

SEQ ID NO: 48676 - protein, 239 aa, Homo sapiens
MRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKLRMEELKILSDTYTVEKVEVHRLIRDRLEGAIHLQEQDMENSRQVLNSYEVLGEEFDRLVKEYTVLKQATENKRWALQEFSKVYR

SEQ ID NO: 48677 - protein, 363 aa, Homo sapiens; identical to SEQ ID NO: 48672

SEQ ID NO: 48678 - protein, 17 aa, Homo sapiens
MRLLGPSQEREIPPLLG

SEQ ID NO: 48679 - protein, 187 aa, Homo sapiens
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNS

SEQ ID NO: 48680 - protein, 279 aa, Homo sapiens
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWMRARLQQEVEEQLKKKCFTLLCYYDPNSDADSETVKAAKVWKLAEVLVGEQQQCQDAKSQQKEQMLLLEKKSAAYSQVLLRCLTLLQRLLQEHRLKTQSELDRINAQYLEVKCGAMILKL

SEQ ID NO: 48681 - protein, 318 aa, Homo sapiens; identical to SEQ ID NO: 48673

SEQ ID NO: 48682 - protein, 318 aa, Homo sapiens; identical to SEQ ID NO: 48673

SEQ ID NO: 48683 - protein, 160 aa, Homo sapiens
MASGDFCSPGEGMEILQQVCSKQLPPCNLSKEDLLQNPYFSKLLLNLSQHVDESGLSLTLAKEQAQAWKEVRLHKTTWLRSEILHRVIQELLVDYYVKIQDTNVTSEDKKFHETLEQRLLVTELMRLLGPSQEREIPPLLGLEKADLLELMPLSEDFVWM

SEQ ID NO: 48684 - protein, 633 aa, Homo sapiens
MELAQEARELGCWAVEEMGVPVAARAPESTLRRLCLGQGADIWAYILQHVHSQRTVKKIRGNLLWYGHQDSPQVRRKLELEAAVTRLRAEIQELDQSLELMERDTEAQDTAMEQARQHTQDTQRRALLLRAQAGAMRRQQHTLRDPMQRLQNQLRRLQDMERKAKVDVTFGSLTSAALGLEPVVLRDVRTACTLRAQFLQNLLLPQAKRGSLPTPHDDHFGTSYQQWLSSVETLLTNHPPGHVLAALEHLAAEREAEIRSLCSGDGLGDTEISRPQAPDQSDSSQTLPSMVHLIQEGWRTVGVLVSQRSTLLKERQVLTQRLQGLVEEVERRVLGSSERQVLILGLRRCCLWTELKALHDQSQELQDAAGHRQLLLRELQAKQQRILHWRQLVEETQEQVRLLIKGNSASKTRLCRSPGEVLALVQRKVVPTFEAVAPQSRELLRCLEEEVRHLPHILLGTLLRHRPGELKPLPTVLPSIHQLHPASPRGSSFIALSHKLGLPPGKASELLLPAAASLRQDLLLLQDQRSLWCWDLLHMKTSLPPGLPTQELLQIQASQEKQQKENLGQALKRLEKLLKQALERIPELQGIVGDWWEQPGQAALSEELCQGLSLPQWRLRWVQAQGALQKLCS

SEQ ID NO: 48685 - protein, 290 aa, Homo sapiens
MELAQEARELGCWAVEEMGVPVAARAPESTLRRLCLGQGADIWAYILQHVHSQRTVKKIRGNLLWYGHQDSPQVRRKLELEAAVTRLRAEIQELDQSLELMERDTEAQDTAMEQARQHTQDTQRRALLLRAQAGAMRRQQHTLRDPMQRLQNQLRRLQDMERKAKVDVTFGSLTSAALGLEPVVLRDVRTACTLRAQFLQNLLLPQAKRGSLPTPHDDHFGTSYQQWLSSVETLLTNHPPGHVLAALEHLAAEREAEIRSLCSGDGLGDTEISRRAGGLWVCWSPSGAPS

SEQ ID NO: 48686 - protein, 802 aa, Homo sapiens
MKYIKSNSKNSSHHFVETFNIKPQDLHKCIARCHFARSRFLQILQRQDCVTQKYQENAQLSVKQVRNLRSECIGLENQIKKMEPYDDHSNMEEKIQKVRSLWASVNETLMFLEKEREVVSSVLSLVNQYALDGTNVAINIPRLLLDKIEKQMFQLHIGNVYEAGKLNLLTVIQLLNEVLKVMKYERCQADQARLTVDLHYLEKETKFQKERLSDLKHMRYRIKDDLTTIRHSVVEKQGEWHKKWKEFLGLSPFSLIKGWTPSVDLLPPMSPLSFDPASEEVYAKSILCQYPASLPDAHKQHNQENGCRGDSDTLGALHDLANSPASFLSQSVSSSDRNSVTVLEKDTKMGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKGKV

SEQ ID NO: 48687 - protein, 955 aa, Homo sapiens
MSSASVTAFEKEHLWMYLQALGFEPGPATIACGKIVSHTHLGVNMFDKLNRDAFHIISYFLFQVLDQSLTKEVFKFCWPPFDQKSDTEFRKHCCEWIKRISGECGSSFPQVVGSLFLSPGGPKFIHLMYHFARFVAMKYIKSNSKNSSHHFVETFNIKPQDLHKCIARCHFARSRFLQILQRQDCVTQKYQENAQLSVKQVRNLRSECIGLENQIKKMEPYDDHSNMEEKIQKVRSLWASVNETLMFLEKEREVVSSVLSLVNQYALDGTNVAINIPRLLLDKIEKQMFQLHIGNVYEAGKLNLLTVIQLLNEVLKVMKYERCQADQARLTVDLHYLEKETKFQKERLSDLKHMRYRIKDDLTTIRHSVVEKQGEWHKKWKEFLGLSPFSLIKGWTPSVDLLPPMSPLSFDPASEEVYAKSILCQYPASLPDAHKQHNQENGCRGDSDTLGALHDLANSPASFLSQSVSSSDRNSVTVLEKDTKMGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKEEDILNKSLDAKEPPSDLTR

SEQ ID NO: 48688 - protein, 183 aa, Homo sapiens
MGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQ

SEQ ID NO: 48689 - protein, 358 aa, Homo sapiens
MAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQLLQVVMAVADTSAKAVETVKKQQGEQICWGGSSSVMSLATKMNELMEK

SEQ ID NO: 48690 - protein, 427 aa, Homo sapiens
MGGARLGARNMAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQIPRGQPKKPALVTMTTVPTCATLPLAQGFRDVHFGFLSERLRAFQPLTGWSCETPRSGMLLQVVMAVADTSAKAVETVKKQQGEQICWGGSSSVMSLATKMNELMEK

SEQ ID NO: 48691 - protein, 368 aa, Homo sapiens
MGGARLGARNMAGQDAGCGRGGDDYSEDEGDSSVSRAAVEVFGKLKDLNCPFLEGLYITEPKTIQELLCSPSEYRLEILEWMCTRVWPSLQDRFSSLKGVPTEVKIQEMTKLGHELMLCAPDDQELLKGCACAQKQLHFMDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTEYFAQHEQGAAAGAADISTLDQKLRLVTSDFHQLILAFLQVYDDELGECCQRPGPDLHPCGPIIQATHQNLTSYSQLLQVVMAVADTSAKAVETVKKQQGEQICWGGSSSVMSLATKMNELMEK

SEQ ID NO: 48692 - protein, 136 aa, Homo sapiens
MDQLLDTIRSLTIGCSSCSSLMEHFEDTREKNEALLGELFSSPHLQMLLNPECDPWPLDMQPLLNKQSDDWQWASASAKSEEEEKLAELARQLQESAAKLHALRTESTTTSWASAASAQALTSTRAAPSSRPRTRI

SEQ ID NO: 48693 - protein, 171 aa, Homo sapiens
MVKRRRSPALGEERFSPSSILHPRLPLVLLGTRVPLSGGGPGEPDQGRSAPSWKSLASTHHHSRPAAGATPARPATQSQLGPFAPPLPGVRPAPFPAVEVFGKLKDLNCPFLEGLYITEPKTIQELLCSPSEYRLEILEWMCTRVWPSLQDRFSSLKGVPTEVKIQGLLAG

SEQ ID NO: 48694 - protein, 410 aa, Homo sapiens
MADSSGRGAGKPATGPTNSSSAKKKDKRVQGGRVIESRYLQYEKKTTQKAPAGDGSQTRGKMSEGGRKSSLLQKSKADSSGVGKGDLQSTLLEGHGTAPPDLDLSAINDKSIVKKTPQLAKTISKKPESTSFSAPRKKSPDLSEAMEMMESQTLLLTLLSVKMENNLAEFERRAEKNLLIMCKEKEKLQKKAHELKRRLLLSQRKRELADVLDAQIEMLSPFEAVATRFKEQYRTFATALDTTRHELPVRSIHLEGDGQQLLDALQHELVTTQRLLGELDVGDSEENVQVLDLLSELKDVTAKKDLELRRSFAQVLELSAEASKEAALANQEVWEETQGMAPPSRWYFNQDSACRESGGAPKNTPLSEDDNPGASSAPAQATFISPSEDFSSSSQAEVPPSLSRSGRDLS

SEQ ID NO: 48695 - protein, 409 aa, Homo sapiens
MADSSGRGAGKPATGPTNSSSAKKKDKRVQGGRVIESRYLQYEKKTTQKAPAGDGSQTRGKMSEGGRKSSLLQKSKDSSGVGKGDLQSTLLEGHGTAPPDLDLSAINDKSIVKKTPQLAKTISKKPESTSFSAPRKKSPDLSEAMEMMESQTLLLTLLSVKMENNLAEFERRAEKNLLIMCKEKEKLQKKAHELKRRLLLSQRKRELADVLDAQIEMLSPFEAVATRFKEQYRTFATALDTTRHELPVRSIHLEGDGQQLLDALQHELVTTQRLLGELDVGDSEENVQVLDLLSELKDVTAKKDLELRRSFAQVLELSAEASKEAALANQEVWEETQGMAPPSRWYFNQDSACRESGGAPKNTPLSEDDNPGASSAPAQATFISPSEDFSSSSQAEVPPSLSRSGRDLS

SEQ ID NO: 48696 - protein, 632 aa, Homo sapiens
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGVLFSSSEVSADNVQSSYPQSANHLDYSSKPFDFASSVGKYGLSHNSSVPTHCLLHRKKKLDTRKSEKKLESCKLTKELSLANLIHDMSRDSCESQPSVRLSSTDSLESLLSKNLDADLLRPHASECISKDDSAFKEIPDLKTIIIKGTTPNNSLYIQNNSLSDFQNIPVQDSLGSSNNPLYLTSSLENMTVDNLNASKETEVGNVSLVEQSAKNHTFKNDNLQFSQCESPSLTELFQEHKENNISQCFTLSDLCNQSSASFTDLSLGSFPLSQLANRCQSSPGISELTGSLSSLAFHKASPTRDLENLSLSELIAETIDVDNSQIKKESFEVSLSEVRSPGIDSNIDLSVLIKNPDFVPKPVVDPSIAPSSRTKVLSSKLGKNSNFAKDNKKNNKGSLTRKPPFSLSWTKALAARPSAFASTLCLRYPLKSCKRRTLDLYKTFLYSRQVQDVKDKEISPLVAITPFDFKSASPDDIVKANQKKAFTRE

SEQ ID NO: 48697 - protein, 520 aa, Homo sapiens
MTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 48698 - protein, 642 aa, Homo sapiens
MARHRNVRGYNYDEDFEDDDLYGQSVEDDYCISPSTARLYSCLDHMREVLGDAVPDEILIEAVLKNKFDVQKALSGVLEQDRVQSLKDKNEATVSTGKIAKGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 48699 - protein, 684 aa, Homo sapiens
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 48700 - protein, 408 aa, Homo sapiens
MGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 48701 - protein, 279 aa, Homo sapiens
MSLFDLFRGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPELPGPESETPGERLREGQTLRDSMLKYPDSHQPRIFGGVLESDARSESPQPAPDWGSQRPFHRFDDVWPMDPHPRTREDNDLDSQVSQEGLGPVLQPQPKSYFKSISVTKITKPDGIVEERRTVVDSEGRTETTVTRHEADSSPRGDPESPRPPALDDAFSILDLFLGRWFRSR

SEQ ID NO: 48702 - protein, 231 aa, Homo sapiens
MSLFDLFRGFFGFPGPRSFSPGGGIRFHDNFGFDDLVRDFNSIFSDMGAWTLPSHPPELPGPESETPGERLREGQTLRDSMLKYPDSHQPRIFGGVLESDARSESPQPAPDWGSQRPFHRFDDVWPMDPHPRTREDNDLDSQVSQEGLGPVLQPQPKSYFKSISVTKITKPDGIVEERRTVVDSEGRTETTVTRHEADSSPRGDPESPRPPALDDAFSILDLFLGRWFRSR

SEQ ID NO: 48703 - protein, 287 aa, Homo sapiens
MSLFDLFRGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPANTCHLSAELPGPESETPGERLREGQTLRDSMLKYPDSHQPRIFGGVLESDARSESPQPAPDWGSQRPFHRFDDVWPMDPHPRTREDNDLDSQVSQEGLGPVLQPQPKSYFKSISVTKITKPDGIVEERRTVVDSEGRTETTVTRHEADSSPRGDPESPRPPALDDAFSILDLFLGRWFRSR

SEQ ID NO: 48704 - protein, 392 aa, Homo sapiens
MQSPAVLVTSRRLQNAHTGLDLTVPQHQEVRGKMMSGHVEYQILVVTRLAAFKSAKHRPEDVVQFLVSKKYSEIEEFYQKLSSRYAAASLPPLPRKVLFVGESDIRERRAVFNEILRCVSKDAELAGSPELLEFLGTRSPGAAGLTSRDSSVLDGTDSQTGNDEEAFDFFEEQDQVAEEGPPVQSLKGEDAEESLEEEEALDPLGIMRSKKPKKHPKVAVKAKPSPRLTIFDEEVDPDEGLFGPGRKLSPQDPSEDVSSVDPLKLFDDPDLGGAIPLGDSLLLPAACESGGPTPSLSHRDASKELFRVEEDLDQILNLGAEPKPKPQLKPKPPVAAKPVIPRKPAVPPKAGPAEAVAGQQKPQEQIQAMDEMDILQYIQDHDTPAQAAPSLF

SEQ ID NO: 48705 - protein, 217 aa, Homo sapiens
MSLVGGFPHHPVVHHEGYPFAAAAAAAAAAAASRCSHEENPYFHGWLIGHPEMSPPDYSMALSYSPEYASGAAGLDHSHYGGVPPGAGPPGLGGPRPVKRRGTANRKERRRTQSINSAFAELRECIPNVPADTKLSKIKTLRLATSYIAYLMDLLAKDDQNGEAEAFKAEIKKTDVKEEKRKKELNEILKSTVSSNDKKTKGRTGWPQHVWALELKQ

SEQ ID NO: 48706 - protein, 186 aa, Homo sapiens
MSLVGGFPHHPVVHHEGYPFAAAAAAAAAAAASRCSHEENPYFHGWLIGHPEMSPPDYSMALSYSPEYASGTANRKERRRTQSINSAFAELRECIPNVPADTKLSKIKTLRLATSYIAYLMDLLAKDDQNGEAEAFKAEIKKTDVKEEKRKKELNEILKSTVSSNDKKTKGRTGWPQHVWALELKQ

SEQ ID NO: 48707 - protein, 165 aa, Homo sapiens
MSPPDYSMALSYSPEYASGAAGLDHSHYGGVPPGAGPPGLGGPRPVKRRGTANRKERRRTQSINSAFAELRECIPNVPADTKLSKIKTLRLATSYIAYLMDLLAKDDQNGEAEAFKAEIKKTDVKEEKRKKELNEILKSTVSSNDKKTKGRTGWPQHVWALELKQ

SEQ ID NO: 48708 - protein, 858 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 48709 - protein, 137 aa, Homo sapiens
MFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNDSCGIVNSY

SEQ ID NO: 48710 - protein, 677 aa, Homo sapiens
MYMGEEHLFSVEQITAMLLTKLKETAENSLKKPVTDCVISVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 48711 - protein, 639 aa, Homo sapiens
MARERPCRCHGNGGRSPGTGCPLGRIFPEGSRRRKRKWHVEGPVEAPRNGQTPRAGAERGQGRKRRQEKQAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKQMKKKLTSLQKLKSPK

SEQ ID NO: 48712 - protein, 860 aa, Homo sapiens
MATAAVLRGPAAHWVESFQKAREEGSGSGTWRGRWRRRSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 48713 - protein, 102 aa, Homo sapiens
MAGQAFRKFLPLFDRVLVERSAAETVTKGGIMLPEKSQGKVLQATVVAVGSGSKGKGGEIQPVSVKVGDKVLLPEYGGTKVVLDDKDYFLFRDGDILGKYVD

SEQ ID NO: 48714 - protein, 101 aa, Homo sapiens
MAGQAFRKFLPLFDRVLVERSAAETVTKGGIMLPEKSQGKVLQATVVAVGSGSKGKGGEIQPVSVKVGDKVLLPEYGGTKVVLDDKVCKLNNSKKKSDICN

SEQ ID NO: 48715 - protein, 47 aa, Homo sapiens
MGGEIQPVSVKVGDKVLLPEYGGTKVVLDDKDYFLFRDGDILGKYVD

SEQ ID NO: 48716 - protein, 196 aa, Homo sapiens
MADGQMPFSCHYPSRLRRDPFRDSPLSSRLLDDGFGMDPFPDDLTASWPDWALPRLSSAWPGTLRSGMVPRGPTATARFGVPAEGRTPPPFPGEPWKVCVNVHSFKPEELMVKTKDGYVEVSGKHEEKQQEGGIVSKNFTKKIQLPAEVDPVTVFASLSPEGLLIIEAPQVPPYSTFGESSFNNELPQDSQEVTCT

SEQ ID NO: 48717 - protein, 150 aa, Homo sapiens
MAKIILRHLIEIPVRYQEEFEARGLEDCRLDHALYALPGPTIVDLRKTRAAQSPPVDSAAETPPREGKSHFQILLDVVQFLPEDIIIQTFEGWLLIKAQHGTRMDEHGFISRSFTRQYKLPDGVEIKDLSAVLCHDGILVVEVKDPVGTK

SEQ ID NO: 48718 - protein, 170 aa, Homo sapiens
MSHRTSSTFRAERSFHSSSSSSSSSTSSSASRALPAQDPPMEKALSMFSDDFGSFMRPHSEPLAFPARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 48719 - protein, 263 aa, Homo sapiens
MSGCELSPLGLRVGLSAGPAHGRRFPAPSGPWRGLNLASRQGAGPKPRDSRPYKAAAVGAWHARPEACAHTLSCPALARLGRARRRPWMSHRTSSTFRAERSFHSSSSSSSSSTSSSASRALPAQDPPMEKALSMFSDDFGSFMRPHSEPLAFPAAHPTARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 48720 - protein, 175 aa, Homo sapiens
MSHRTSSTFRAERSFHSSSSSSSSSTSSSASRALPAQDPPMEKALSMFSDDFGSFMRPHSEPLAFPAAHPTARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 48721 - protein, 68 aa, Homo sapiens
MSHRTSSTFRAERSFHSSSSSSSSSTSSSASRALPAQDPPMEKALSMFSDDFGSFMRPHSEPLAFPGK

SEQ ID NO: 48722 - protein, 573 aa, Homo sapiens
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEKLNERLAKLSDGVAVLKVGGTSDVEVNEKKDRVTDALNATRAAVEEGIVLGGGCALLRCIPALDSLTPANEDQKIGIEIIKRTLKIPAMTIAKNAGVEGSLIVEKIMQSSSEVGYDAMAGDFVNMVEKGIIDPTKVVRTALLDAAGVASLLTTAEVVVTEIPKEEKDPGMGAMGGMGGGMGGGMF

SEQ ID NO: 48723 - protein, 573 aa, Homo sapiens; identical to SEQ ID NO: 48722

SEQ ID NO: 48724 - protein, 58 aa, Homo sapiens
MLRLPTVFRQMRPVSRVLAPHLTRAYAKDVKFGADARALMLQGVDLLADAVAVTMGPK

SEQ ID NO: 48725 - protein, 94 aa, Homo sapiens
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIG

SEQ ID NO: 48726 - protein, 234 aa, Homo sapiens [sequence omitted]

SEQ ID NO: 48727 - protein, 83 aa, Homo sapiens
MLRLPTVFRQMRPVSRVLAPHLTRAYAKDVKFGADARALMLQGVDLLADAVAVTMGPKGRTVIIEQSWGSPKVTKDGVTVAKS

SEQ ID NO: 48728 - protein, 221 aa, Homo sapiens
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDR

SEQ ID NO: 48729 - protein, 245 aa, Homo sapiens
MLAVDAVIAELKKQSKPVTTPEEIAQVATISANGDKEIGNIISDAMKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEN

SEQ ID NO: 48730 - protein, 158 aa, Homo sapiens
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGRNVCCHHSVLNFSVL

SEQ ID NO: 48731 - protein, 686 aa, Homo sapiens
MLAVPEMGLQGLYIGSSPERSPVPSPPGSPRTQESCGIAPLTPSQSPKPEVRAPQQASFSVVVAIDFGTTSSGYAFSFASDPEAIHMMRKWEGGDPGVAHQKTPTCLLLTPEGAFHSFGYTARDYYHDLDPEEARDWLYFEKFKMKIHSATDLTLKTQLEAVNGKTMPALEVFAHALRFFREHALQELREQSPSLPEKDTVRWVLTVPAIWKQPAKQFMREAAYLAGLVSRENAEQLLIALEPEAASVYCRKLRLHQLLDLSGRAPGGGRLGERRSIDSSFRQAREQLRRSRHSRTFLVESGVGELWAEMQAGDRYVVADCGGGTVDLTVHQLEQPHGTLKELYKASGGPYGAVGVDLAFEQLLCRIFGEDFIATFKRQRPAAWVDLTIAFEARKRTAGPHRAGALNISLPFSFIDFYRKQRGHNVETALRRSSVNFVKWSSQGMLRMSCEAMNELFQPTVSGIIQHIEALLARPEVQGVKLLFLVGGFAESAVLQHAVQAALGARGLRVVVPHDVGLTILKGAVLFGQAPGVVRVRRSPLTYGVGVLNRFVPGRHPPEKLLVRDGRRWCTDVFERFVAAEQSVALGEEVRRSYCPARPGQRRVLINLYCCAAEDARFITDPGVRKCGALSLELEPADCGQDTAGAPPGRREIRAAMQFGDTEIKVTAVDVSTNRSVRASIDFLSN

SEQ ID NO: 48732 - protein, 600 aa, Homo sapiens
MMRKWEGGDPGVAHQKTPTCLLLTPEGAFHSFGYTARDYYHDLDPEEARDWLYFEKFKMKIHSATDLTLKTQLEAVNGKTMPALEVFAHALRFFREHALQELREQSPSLPEKDTVRWVLTVPAIWKQPAKQFMREAAYLAGLVSRENAEQLLIALEPEAASVYCRKLRLHQLLDLSGRAPGGGRLGERRSIDSSFRQAREQLRRSRHSRTFLVESGVGELWAEMQAGDRYVVADCGGGTVDLTVHQLEQPHGTLKELYKASGGPYGAVGVDLAFEQLLCRIFGEDFIATFKRQRPAAWVDLTIAFEARKRTAGPHRAGALNISLPFSFIDFYRKQRGHNVETALRRSSVNFVKWSSQGMLRMSCEAMNELFQPTVSGIIQHIEALLARPEVQGVKLLFLVGGFAESAVLQHAVQAALGARGLRVVVPHDVGLTILKGAVLFGQAPGVVRVRRSPLTYGVGVLNRFVPGRHPPEKLLVRDGRRWCTDVFERFVAAEQSVALGEEVRRSYCPARPGQRRVLINLYCCAAEDARFITDPGVRKCGALSLELEPADCGQDTAGAPPGRREIRAAMQFGDTEIKVTAVDVSTNRSVRASIDFLSN

SEQ ID NO: 48733 - protein, 520 aa, Homo sapiens
MPALEVFAHALRFFREHALQELREQSPSLPEKDTVRWVLTVPAIWKQPAKQFMREAAYLAGLVSRENAEQLLIALEPEAASVYCRKLRLHQLLDLSGRAPGGGRLGERRSIDSSFRQAREQLRRSRHSRTFLVESGVGELWAEMQAGDRYVVADCGGGTVDLTVHQLEQPHGTLKELYKASGGPYGAVGVDLAFEQLLCRIFGEDFIATFKRQRPAAWVDLTIAFEARKRTAGPHRAGALNISLPFSFIDFYRKQRGHNVETALRRSSVNFVKWSSQGMLRMSCEAMNELFQPTVSGIIQHIEALLARPEVQGVKLLFLVGGFAESAVLQHAVQAALGARGLRVVVPHDVGLTILKGAVLFGQAPGVVRVRRSPLTYGVGVLNRFVPGRHPPEKLLVRDGRRWCTDVFERFVAAEQSVALGEEVRRSYCPARPGQRRVLINLYCCAAEDARFITDPGVRKCGALSLELEPADCGQDTAGAPPGRREIRAAMQFGDTEIKVTAVDVSTNRSVRASIDFLSN

SEQ ID NO: 48734 - protein, 675 aa, Homo sapiens
MADKEAGGSDGPRETAPTSAYSSPARSLGDTGITPLSPSHIVNDTDSNVSEQQSFLVVVAVDFGTTSSGYAYSFTKEPECIHVMRRWEGGDPGVSNQKTPTTILLTPERKFHSFGYAARDFYHDLDPNEAKQWLYLEKFKMKLHTTGDLTMDTDLTAANGKKVKALEIFAYALQYFKEQALKELSDQAGSEFENSDVRWVITVPAIWKQPAKQFMRQAAYQAGLASPENSEQLIIALEPEAASIYCRKLRLHQMIELSSKAAVNGYSGSDTVGAGFTQAKEHIRRNRQSRTFLVENVIGEIWSELEEGDKYVVVDSGGGTVDLTVHQIRLPEGHLKELYKATGGPYGSLGVDYEFEKLLYKIFGEDFIEQFKIKRPAAWVDLMIAFESRKRAAAPDRTNPLNITLPFSFIDYYKKFRGHSVEHALRKSNVDFVKWSSQGMLRMSPDAMNALFKPTIDSIIEHLRDLFQKPEVSTVKFLFLVGGFAEAPLLQQAVQAAFGDQCRIIIPQDVGLTILKGAVLFGLDPAVIKVRRSPLTYGVGVLNRYVEGKHPPEKLLVKDGTRWCTDVFDKFISADQSVALGELVKRSYTPAKPSQLVIVINIYSSEHDNVSFITDPGVKKCGTLRLDLTGTSGTAVPARREIQTLMQFGDTEIKATAIDIATSKSVKVGIDFLNY

SEQ ID NO: 48735 - protein, 272 aa, Homo sapiens [sequence omitted]

SEQ ID NO: 48736 - protein, 509 aa, Homo sapiens
MAAIGVHLGCTSACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKETAHSVLGSDANDVVITVPFDFGEKQKNALGEAARAAGFNVLRLIHEPSAALLAYGIGQDSPTGKSNILVFKLGGTSLSLSVMEVNSGIYRVLSTNTDDNIGGAHFTETLAQYLASEFQRSFKHDVRGNARAMMKLTNSAEVAKHSLSTLGSANCFLDSLYEGQDFDCNVSRARFELLCSPLFNKCIEAIRGLLDQNGFTADDINKVVLCGGSSRIPKLQQLIKDLFPAVELLNSIPPDEVIPIGAAIEAGILIGKENLLVEDSLMIECSARDILVKGVDESGASRFTVLFPSGTPLPARRQHTLQAPGSISSVCLELYESDGKNSAKEETKFAQVVLQDLDKKENGLRDILAVLTMKRDGSLHVTCTDQETGKCEAISIEIAS

SEQ ID NO: 48737 - protein, 143 aa, Homo sapiens
MAAIGVHLGCTSACVAVYKDGRAGVVANDAGDRVTPAVVAYSENEEIVGLAAKQSRIRNISNTVMKVKQILGRRVLSRDPQLQQLPQPFQRCSCSLSEQPHGQTGCVRGAQPLHQHQPQHSWGSLHTADSSLLFESWFCFWWG

SEQ ID NO: 48738 - protein, 128 aa, Homo sapiens
  MOD_RES (1)..(1): Any amino acid
XACVAVYKDGRAGVVANDAGDRVTPAVVAYSENEEIVGLAAKQSRIRNISNTVMKVKQILGRSSSDPQAQKYIAESKCLVIEKNGKLRYEIDTGEETKFVNPEDVARLIFSKMKGAYSPWSQSNSEDG

SEQ ID NO: 48739 - protein, 641 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 48740 - protein, 476 aa, Homo sapiens
MAKAAAIGIDLGTTYSCVGVFQHGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 48741 - protein, 476 aa, Homo sapiens; identical to SEQ ID NO: 48740

SEQ ID NO: 48742 - protein, 641 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGDTKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 48743 - protein, 476 aa, Homo sapiens; identical to SEQ ID NO: 48740

SEQ ID NO: 48744 - protein, 641 aa, Homo sapiens; identical to SEQ ID NO: 48739

SEQ ID NO: 48745 - protein, 641 aa, Homo sapiens; identical to SEQ ID NO: 48739

SEQ ID NO: 48746 - protein, 232 aa, Homo sapiens
MAKAAAIGIDLGTTYSCVGVFQHGKVEIIANDQGNRTTPSYVAFTDTERLIGDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKAPPASPRCRSCCRTSSTGAT

SEQ ID NO: 48747 - protein, 641 aa, Homo sapiens; identical to SEQ ID NO: 48739

SEQ ID NO: 48748 - protein, 476 aa, Homo sapiens; identical to SEQ ID NO: 48740

SEQ ID NO: 48749 - protein, 476 aa, Homo sapiens; identical to SEQ ID NO: 48740

SEQ ID NO: 48750 - protein, 550 aa, Homo sapiens
MAKAAAIGIDLGTTYSCVGVFQHGKVQISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 48751 - protein, 623 aa, Homo sapiens
MAKAAAIGIDLGTTYSCVGVFQHGKVEIIANDQGNRTTPSYVAFTDTERLIGDAAKNQVALNPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 48752 - protein, 550 aa, Homo sapiens; identical to SEQ ID NO: 48750

SEQ ID NO: 48753 - protein, 550 aa, Homo sapiens; identical to SEQ ID NO: 48750

SEQ ID NO: 48754 - protein, 550 aa, Homo sapiens; identical to SEQ ID NO: 48750

SEQ ID NO: 48755 - protein, 232 aa, Homo sapiens; identical to SEQ ID NO: 48746

SEQ ID NO: 48756 - protein, 550 aa, Homo sapiens; identical to SEQ ID NO: 48750

SEQ ID NO: 48757 - protein, 232 aa, Homo sapiens; identical to SEQ ID NO: 48746

SEQ ID NO: 48758 - protein, 232 aa, Homo sapiens; identical to SEQ ID NO: 48746

SEQ ID NO: 48759 - protein, 232 aa, Homo sapiens; identical to SEQ ID NO: 48746

SEQ ID NO: 48760 - protein, 641 aa, Homo sapiens; identical to SEQ ID NO: 48739

SEQ ID NO: 48761 - protein, 641 aa, Homo sapiens; identical to SEQ ID NO: 48739

SEQ ID NO: 48762 - protein, 641 aa, Homo sapiens; identical to SEQ ID NO: 48739

SEQ ID NO: 48763 - protein, 232 aa, Homo sapiens; identical to SEQ ID NO: 48746

SEQ ID NO: 48764 - protein, 641 aa, Homo sapiens; identical to SEQ ID NO: 48739

SEQ ID NO: 48765 - protein, 641 aa, Homo sapiens; identical to SEQ ID NO: 48739

SEQ ID NO: 48766 - protein, 708 aa, Homo sapiens
LRSCCEGPLRLSRVTPAVPRLSRANLCGCRHRRVEFPAFRRTELLSRIPSAVSSPQSQSGAHRQGTGMAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 48767 - protein, 550 aa, Homo sapiens; identical to SEQ ID NO: 48750

SEQ ID NO: 48768 - protein, 624 aa, Homo sapiens
MAKAAAIGIDLGTTYSCVGVFQHGKVEIIANDQGNRTTPSYVAFTDTERLIGDAAKNQVALNPPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 48769 - protein, 618 aa, Homo sapiens
MAKAAAIGIDLGTTYSCVGVFQHGKVEIIANDQGNRTTPSYVAFTDTERLIGDAAKNQVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 48770 - protein, 618 aa, Homo sapiens; identical to SEQ ID NO: 48769

SEQ ID NO: 48771 - protein, 550 aa, Homo sapiens; identical to SEQ ID NO: 48750

SEQ ID NO: 48772 - protein, 618 aa, Homo sapiens; identical to SEQ ID NO: 48769

SEQ ID NO: 48773 - protein, 550 aa, Homo sapiens; identical to SEQ ID NO: 48750

SEQ ID NO: 48774 - protein, 586 aa, Homo sapiens
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTATDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 48775 - protein, 641 aa, Homo sapiens
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTATDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 48776 - protein, 641 aa, Homo sapiens
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTAMDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 48777 - protein, 641 aa, Homo sapiens; identical to SEQ ID NO: 48775

SEQ ID NO: 48778 - protein, 641 aa, Homo sapiens; identical to SEQ ID NO: 48775

SEQ ID NO: 48779 - protein, 232 aa, Homo sapiens
AKGIAIGIDLGTTYSCVGVFQHGKVEIIANDQGNRTTPSYVAFTDTERLIGDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKGAPPASPRCSGCFRTTSMDVI

SEQ ID NO: 48780 - protein, 641 aa, Homo sapiens; identical to SEQ ID NO: 48776

SEQ ID NO: 48781 - protein, 532 aa, Homo sapiens [sequence omitted]

SEQ ID NO: 48782 - protein, 232 aa, Homo sapiens; identical to SEQ ID NO: 48779

SEQ ID NO: 48783 - protein, 641 aa, Homo sapiens; identical to SEQ ID NO: 48775

SEQ ID NO: 48784 - protein, 532 aa, Homo sapiens [sequence omitted]

SEQ ID NO: 48785 - protein, 532 aa, Homo sapiens
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTATDKSTGKVNKITITNDKGRLSKEEIERMVLDAEKYKAEDV

SEQ ID NO: 48786 - protein, 641 aa, Homo sapiens; identical to SEQ ID NO: 48776

SEQ ID NO: 48787 - protein, 232 aa, Homo sapiens; identical to SEQ ID NO: 48779

SEQ ID NO: 48788 - protein, 232 aa, Homo sapiens; identical to SEQ ID NO: 48779

SEQ ID NO: 48789 - protein, 641 aa, Homo sapiens; identical to SEQ ID NO: 48776

SEQ ID NO: 48790 - protein, 639 aa, Homo sapiens
MSARGPAIGIDLGTTYSCVGVFQHGKVEIIANDQGNRTTPSYVAFTDTERLIGDAAKNQVAMNPTNTIFDAKRLIGRKFEDATVQSDMKHWPFRVVSEGGKPKVQVEYKGETKTFFPEEISSMVLTKMKEIAEAYLGGKVHSAVITVPAYFNDSQRQATKDAGTITGLNVLRIINEPTAAAIAYGLDKKGCAGGEKNVLIFDLGGGTFDVSILTIEDGIFEVKSTAGDTHLGGEDFDNRMVSHLAEEFKRKHKKDIGPNKRAVRRLRTACERAKRTLSSSTQASIEIDSLYEGVDFYTSITRARFEELNADLFRGTLEPVEKALRDAKLDKGQIQEIVLVGGSTRIPKIQKLLQDFFNGKELNKSINPDEAVAYGAAVQAAILIGDKSENVQDLLLLDVTPLSLGIETAGGVMTPLIKRNTTIPTKQTQTFTTYSDNQSSVLVQVYEGERAMTKDNNLLGKFDLTGIPPAPRGVPQIEVTFDIDANGILNVTAADKSTGKENKITITNDKGRLSKDDIDRMVQEAERYKSEDEANRDRVAAKNALESYTYNIKQTVEDEKLRGKISEQDKNKILDKCQEVINWLDRNQMAEKDEYEHKQKELERVCNPIISKLYQGGPGGGSGGGGSGASGGPTIEEVD

SEQ ID NO: 48791 - protein, 639 aa, Homo sapiens; identical to SEQ ID NO: 48790

SEQ ID NO: 48792 - protein, 413 aa, Homo sapiens
MSARGPAIGIDLGTTYSCVGVFQHGKVEIIANDQGNRTTPSYVAFTDTERLIGDAAKNQVAMNPTNTIFDAKRLIGRKFEELNADLFRGTLEPVEKALRDAKLDKGQIQEIVLVGGSTRIPKIQKLLQDFFNGKELNKSINPDEAVAYGAAVQAAILIGDKSENVQDLLLLDVTPLSLGIETAGGVMTPLIKRNTTIPTKQTQTFTTYSDNQSSVLVQVYEGERAMTKDNNLLGKFDLTGIPPAPRGVPQIEVTFDIDANGILNVTAADKSTGKENKITITNDKGRLSKDDIDRMVQEAERYKSEDEANRDRVAAKNALESYTYNIKQTVEDEKLRGKISEQDKNKILDKCQEVINWLDRNQMAEKDEYEHKQKELERVCNPIISKLYQGGPGGGSGGGGSGASGGPTIEEVD

SEQ ID NO: 48793 - protein, 840 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 48794 - protein, 148 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEEQNGPVDGQGDNPGPQAAEQGTDTAVPSDSDKKLPEMDID

SEQ ID NO: 48795 - protein, 473 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPGFALSRSCYSIIKSLLSLMAPVQK

SEQ ID NO: 48796 - protein, 654 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 48797 - protein, 278 aa, Homo sapiens [sequence omitted]

SEQ ID NO: 48798 - protein, 643 aa, Homo sapiens
MQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVRVCYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALRRLRTACERAKRTLSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 48799 - protein, 619 aa, Homo sapiens
MQAPRELAVGIDLGTTYSCVAFTDTERLVGDAAKSQAALNPHNTVFDAKRLIGRKFADTTVQSDMKHWPFRVVSEGGKPKVRVCYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALRRLRTACERAKRTLSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 48800 - protein, 646 aa, Homo sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 48801 - protein, 493 aa, Homo sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGMPGGMPGGFPGGGAPPSGGASSGPTIEEVD

SEQ ID NO: 48802 - protein, 627 aa, Homo sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 48803 - protein, 646 aa, Homo sapiens; identical to SEQ ID NO: 48800

SEQ ID NO: 48804 - protein, 500 aa, Homo sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 48805 - protein, 410 aa, Homo sapiens
MVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 48806 - protein, 646 aa, Homo sapiens; identical to SEQ ID NO: 48800

SEQ ID NO: 48807 - protein, 679 aa, Homo sapiens
MISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 48808 - protein, 665 aa, Homo sapiens
MISASRAAAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 48809 - protein, 632 aa, Homo sapiens
MALVMRLLDLFQGGIMHQKQSREQLLVLIWVLPTPAWQLWKVNKQRCWRMPKVPEPPLQLWPLQQMVSDLLECRPSDRLSPTQTIHFMLPSVSLAGDMMILKYRKTLKMFPLKLSVPPMVMPVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 48810 - protein, 724 aa, Homo sapiens
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 48811 - protein, 724 aa, Homo sapiens; identical to SEQ ID NO: 48810

SEQ ID NO: 48812 - protein, 154 aa, Homo sapiens
MDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVCPCPTWLPLLVSSVFFPLLSLC

SEQ ID NO: 48813 - protein, 162 aa, Homo sapiens
MDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERCPCPTWLPLLVSSVFFPLLSLC

SEQ ID NO: 48814 - protein, 183 aa, Homo sapiens
MDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGSPCWCLVFFSLSCPCVEGSKLRVSSPIPSLLLTAGLDVVYCGLFYFLHFVLKLKYAK

SEQ ID NO: 48815 - protein, 724 aa, Homo sapiens; identical to SEQ ID NO: 48810

SEQ ID NO: 48816 - protein, 142 aa, Homo sapiens
  MOD_RES (1)..(1): Any amino acid
XFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVCPCPTWLPLLVSSVFFPLLSLC

SEQ ID NO: 48817 - protein, 150 aa, Homo sapiens
  MOD_RES (1)..(1): Any amino acid
XFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERCPCPTWLPLLVSSVFFPLLSLC

SEQ ID NO: 48818 - protein, 171 aa, Homo sapiens
  MOD_RES (1)..(1): Any amino acid
XFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGSPCWCLVFFSLSCPCVEGSKLRVSSPIPSLLLTAGLDVVYCGLFYFLHFVLKLKYAK

SEQ ID NO: 48819 - protein, 168 aa, Homo sapiens
MPEEVHHGEEEVETFAFQAEIAQLMSLIINTFYSNKEIFLRELISNASDALDKIRYESLTDPSKLDSGKELKIDISMIGQFGVGFYSAYLVAEKVVVITKHNDDEQYAWESSAGGSFTVRADHGEPIGRGTKVILHLKEDQTEYLEERRVKEVVKKHSQFIGYPITLY

SEQ ID NO: 48820 - protein, 160 aa, Homo sapiens
MEIPVPVQPSWLRRASAPLPGLSAPGRLFDQRFGEGLLEAELAALCPTTLAPYYLRAPSVALPVAQVPTDPGHFSVLLDVKHFSPEEIAVKVVGEHVEVHARHEERPDEHGFVAREFHRRYRLPPGVDPAAVTSALSPEGVLSIQAAPASAQAPPPAAAK

SEQ ID NO: 48821 - protein, 160 aa, Homo sapiens; identical to SEQ ID NO: 48820

SEQ ID NO: 48822 - protein, 196 aa, Homo sapiens
MEIPVPVQPSWLRRASAPLPGLSAPGRLFDQRFGEGLLEAELAALCPTTLAPYYLRAPSVALPVAQVPTDPGHFSVLLDVKHFSPEEIAVKVVGEHVEVHARHEERPDEHGFVAREFHRRYRLPPGVDPAAVTSALSPEGVLSIQAAPAPREPPQAPSIKADLTPPSQMSRVRQGLSSHPLLDSALTSILDTALIT

SEQ ID NO: 48823 - protein, 529 aa, Homo sapiens
MDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 48824 - protein, 536 aa, Homo sapiens
MKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDLFTSSVQMNPTDYINNTKSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 48825 - protein, 518 aa, Homo sapiens
MKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 48826 - protein, 334 aa, Homo sapiens
MGEAGAAEEACRHMGTKEEFVKVRKKDLERLTTEVMQIRDFLPRILNGEVLESFQKLKIVEKNLERKEQELEQLKMDCEHFKARLETVQADNIREKKEKLALRQQLNEAKQQLLQQAEYCTEMGAAACTLLWGVSSSEEVVKAILGGDKALKFFSITGQTMESFVKSLDGDVQELDSDESQFVFALAGIVTNVAAIACGREFLVNSSRVLLDTILQLLGDLKPGQCTKLKVLMLMSLYNVSINLKGLKYISESPGFIPLLWWLLSDPDAEVCLHVLRLVQSVVLEPEVFSKSASEFRSSLPLQRILAMSKSRNPRLQTAAQELLEDLRTLEHNV

SEQ ID NO: 48827 - protein, 259 aa, Homo sapiens
MDCEHFKARLETVQADNIREKKEKLALRQQLNEAKQQLLQQAEYCTEMGAAACTLLWGVSSSEEVVKAILGGDKALKFFSITGQTMESFVKSLDGDVQELDSDESQFVFALAGIVTNVAAIACGREFLVNSSRVLLDTILQLLGDLKPGQCTKLKVLMLMSLYNVSINLKGLKYISESPGFIPLLWWLLSDPDAEVCLHVLRLVQSVVLEPEVFSKSASEFRSSLPLQRILAMSKSRNPRLQTAAQELLEDLRTLEHNV

SEQ ID NO: 48828 - protein, 492 aa, Homo sapiens
MQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPLPETNLGLSPHRARGPIISDIPEDSPSPEGTRLSPSSDGRREKGLALLKEEPASPGGDGEAGLALAPNECDFCVTAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 48829 - protein, 462 aa, Homo sapiens
MQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPSTYSLSQRQIWALALTGPGAPSSLTSQKTLHPLRGPGFLPPVMAGAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 48830 - protein, 416 aa, Homo sapiens
MQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPLPETNLGLSPHRARGPIISDIPEDSPSPEGTRLSPSSDGRRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 48831 - protein, 492 aa, Homo sapiens; identical to SEQ ID NO: 48828

SEQ ID NO: 48832 - protein, 2 aa, Homo sapiens
MQ

SEQ ID NO: 48833 - protein, 137 aa, Homo sapiens
MSSLIRRVISTAKAPGAIGPYSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL

SEQ ID NO: 48834 - protein, 4834 aa, Homo sapiens
MPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGEDADLCSELLQESLDALRALPEASLFDESTVSSVWLEVVERATRFLRSVVTGDVHGTPATKGPGSIPLQDQHLALAILLELAVQRGTLSQMLSAILLLLQLWDSGAQETDNERSAQGTSAPLLPLLQRFQSIICRKDAPHSEGDMHLLSGPLSPNESFLRYLTLPQDNELAIDLRQTAVVVMAHLDRLATPCMPPLCSSPTSHKGSLQEVIGWGLIGWKYYANVIGPIQCEGLANLGVTQIACAEKRFLILSRNGRVYTQAYNSDTLAPQLVQGLASRNIVKIAAHSDGHHYLALAATGEVYSWGCGDGGRLGHGDTVPLEEPKVISAFSGKQAGKHVVHIACGSTYSAAITAEGELYTWGRGNYGRLGHGSSEDEAIPMLVAGLKGLKVIDVACGSGDAQTLAVTENGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQDIEAKKEAQKEKEIDEQEANASTFHRSRTPLDKDLINTGICESSGKQCLPLVQLIQQLLRNIASQTVARLKDVARRISSCLDFEQHSRERSASLDLLLRFQRLLISKLYPGESIGQTSDISSPELMGVGSLLKKYTALLCTHIGDILPVAASIASTSWRHFAEVAYIVEGDFTGVLLPELVVSIVLLLSKNAGLMQEAGAVPLLGGLLEHLDRFNHLAPGKERDDHEELAWPGIMESFFTGQNCRNNEEVTLIRKADLENHNKDGGFWTVIDGKVYDIKDFQTQSLTGNSILAQFAGEDPVVALEAALQFEDTRESMHAFCVGQYLEPDQEIVTIPDLGSLSSPLIDTERNLGLLLGLHASYLAMSTPLSPVEIECAKWLQSSIFSGGLQTSQIHYSYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESTDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDCTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 48835 - protein, 1024 aa, Homo sapiens
MERRSRRKSRRNGRSTAGKAAATQPAKSPGAQLWLFPSAAGLHRALLRRVEVTRQLCCSPGRLAVLERGGAGVQVHQLLAGSGGARTPKCIKLGKNMKIHSVDQGAEHMLILSSDGKPFEYDNYSMKHLRFESILQEKKIIQITCGDYHSLALSKGGELFAWGQNLHGQLGVGRKFPSTTTPQIVEHLAGVPLAQISAGEAHSMALSMSGNIYSWGKNECGQLGLGHTESKDDPSLIEGLDNQKVEFVACGGSHSALLTQDGLLFTFGAGKHGQLGHNSTQNELRPCLVAELVGYRVTQIACGRWHTLAYVSDLGKVFSFGSGKDGQLGNGGTRDQLMPLPVKVSSSEELKLESHTSEKELIMIAGGNQSILLWIKKENSYVNLKRTIPTLNEGTVKRWIADVETKRWQSTKREIQEIFSSPACLTGSFLRKRRTTEMMPVYLDLNKARNIFKELTQKDWITNMITTCLKDNLLKRLPFHSPPQEALEIFFLLPECPMMHISNNWESLVVPFAKVVCKMSDQSSLVLEEYWATLQESTFSKLVQMFKTAVICQLDYWDESAEENGNVQALLEMLKKLHRVNQVKCQLPESIFQVDELLHRLNFFVEVCRRYLWKMTVDASENVQCCVIFSHFPFIFNNLSKIKLLHTDTLLKIESKKHKAYLRSAAIEEERESEFALRPTFDLTVRRNHLIEDVLNQLSQFENEDLRKELWVSFSGEIGYDLGGVKKEFFYCLFAEMIQPEYGMFMYPEGASCMWFPVKPKFEKKRYFFFGVLCGLSLFNCNVANLPFPLALFKKLLDQMPSLEDLKELSPDLGKNLQTLLDDEGDNFEEVFYIHFNVHWDRNDTNLIPNGSSITVNQTNKRDYVSKYINYIFNDSVKAVYEEFRRGFYKMCDEDIIKLFHPEELKDVIVGNTDYDWKTFEKNARYEPGYNSSHPTIVMFWKAFHKLTLEEKKKFLVFLTGTDRLQMKDLNNMKITFCCPESWNERDPIRALTCFSVLFLPKYSTMETVEEALQEAINNNRGFG

SEQ ID NO: 48836 - protein, 1672 aa, Homo sapiens
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLHMMKYPPSATTLHFEFYADPGAEVKIEKRTTSNTLHYIHIEQLDKISESPSEIMESLTKMYSIPKDKQMLLFTHIRLAHGFSNHRKRLQAVQARLHAISILVYSNALQESANSILYNGLIEELVDVLQITDKQLMEIKAASLRTLTSIVHLERTPKLSSIIDCTGTASYHGFLPVLVRNCIQAMIDPSMDPYPHQFATALFSFLYHLASYDAGGEALVSCGMMEALLKVIKFLGDEQDQITFVTRAVRVVDLITNLDMAAFQSHSGLSIFIYRLEHEVDLCRKECPFVIKPKIQRPNTTQEGEEMETDMDGVQCIPQRAALLKSMLNFLKKAIQDPAFSDGIRHVMDGSLPTSLKHIISNAEYYGPSLFLLATEVVTVFVFQEPSLLSSLQDNGLTDVMLHALLIKDVPATREVLGSLPNVFSALCLNARGLQSFVQCQPFERLFKVLLSPDYLPAMRRRRSSDPLGDTASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQGTSAE

SEQ ID NO: 48837 - protein, 4374 aa, Homo sapiens
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLHMMKYPPSATTLHFEFYADPGAEVKIEKRTTSNTLHYIHIEQLDKISESPSEIMESLTKMYSIPKDKQMLLFTHIRLAHGFSNHRKRLQAVQARLHAISILVYSNALQESANSILYNGLIEELVDVLQITDKQLMEIKAASLRTLTSIVHLERTPKLSSIIDCTGTASYHGFLPVLVRNCIQAMIDPSMDPYPHQFATALFSFLYHLASYDAGGEALVSCGMMEALLKVIKFLGDEQDQITFVTRAVRVVDLITNLDMAAFQSHSGLSIFIYRLEHEVDLCRKECPFVIKPKIQRPNTTQEGEEMETDMDGVQCIPQRAALLKSMLNFLKKAIQDPAFSDGIRHVMDGSLPTSLKHIISNAEYYGPSLFLLATEVVTVFVFQEPSLLSSLQDNGLTDVMLHALLIKDVPATREVLGSLPNVFSALCLNARGLQSFVQCQPFERLFKVLLSPDYLPAMRRRRSSDPLGDTASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 48838 - protein, 4374 aa, Homo sapiens; identical to SEQ ID NO: 48837

SEQ ID NO: 48839 - protein, 256 aa, Homo sapiens
MDPYPHQFATALFSFLYHLASYDAGGEALVSCGMMEALLKVIKFLGDEQDQITFVTRAVRVVDLITNLDMAAFQSHSGLSIFIYRLEHEVDLCRKECPFVIKPKIQRPNTTQEGEEMETDMDVADVAMESSPGSSISMEHRLDVELRASGSSSSTNISSGPSPGPSPGTGPGPGPGPGPGPGPGPGPGPGPGPGPGPGPGPRPGVQCIPQRAALLKSMLNFLKKAIQDPAFSDGIRHVMDGSLPTSLKHIISNAEY

SEQ ID NO: 48840 - protein, 228 aa, Homo sapiens
  MOD_RES (1)..(1): Any amino acid
XVSCGMMEALLKVIKFLGDEQDQITFVTRAVRVVDLITNLDMAAFQSHSGLSIFIYRLEHEVDLCRKECPFVIKPKIQRPNTTQEGEEMETDMDVADVAMESSPGSSISMEHRLDVELRASGSSSSTNISSGPSPGPSPGTGPGPGPGPGPGPGPGPGPGPGPGPGPGPGPGPRPGVQCIPQRAALLKSMLNFLKKAIQDPAFSDGIRHVMDGSLPTSLKHIISNAEY

SEQ ID NO: 48841 - protein, 1197 aa, Homo sapiens
  MOD_RES (1)..(1): Any amino acid
XPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 48842 - protein, 3408 aa, Homo sapiens
  MOD_RES (1)..(1): Any amino acid
XSLPSGCEFGQADMQKLVPKDEKADGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 48843 - protein, 216 aa, Homo sapiens
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLHMMKYPPSATTLHFEFYADPGAEVKIEKRK

SEQ ID NO: 48844 - protein, 93 aa, Homo sapiens
MKVDRTKLKKTPTEAPADCRALIDKLKVCNDEQLLLELQQIKTWNIGKCELYHWVDLLDRFDGILADAGQTVENMSWMLVCDRPEREQLKMLL

SEQ ID NO: 48845 - protein, 493 aa, Homo sapiens
MLPRWELALYLLASLGFHFYSFYEVYKVSREHEEELDQEFELETDTLFGGLKKDATDFEWSFWMEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 48846 - protein, 448 aa, Homo sapiens
MKFTKSPEDATDFEWSFWMEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 48847 - protein, 183 aa, Homo sapiens
MRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 48848 - protein, 493 aa, Homo sapiens; identical to SEQ ID NO: 48845

SEQ ID NO: 48849 - protein, 518 aa, Homo sapiens
MLPRWELALYLLASLGFHFYSFYEVYKVSREHEEELDQEFELETDTLFGGLKKDATDFEWSFWMEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGGLFLFFLLNPCWETAFQGFPVFLHFLQTEVLATFVPNYFSWNICIENTSELSSY

SEQ ID NO: 48850 - protein, 493 aa, Homo sapiens; identical to SEQ ID NO: 48845

SEQ ID NO: 48851 - protein, 207 aa, Homo sapiens
MEWGKQWLVWLLLGHMVVSQMATLLARKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMW

SEQ ID NO: 48852 - protein, 428 aa, Homo sapiens
MLPRWELALYLLASLGFHFYSFYEVYKVSREHEEELDQEFELETDTLFGGLKKDATDFEWSFWMEWGKQWLVWLLLGHMVVSQMATLLARKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 48853 - protein, 356 aa, Homo sapiens
MLPRWELALYLLASLGFHFYSFYEVYKVSREHEEELDQEFELETDTLFGGLKKDATDFEWSFWMEWGKQWLVWLLLGHMVVSQMATLLARKMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 48854 - protein, 494 aa, Homo sapiens
MSLGLGSAERGVLGTRGARERCRRRRPGQPGEHEEELDQEFELETDTLFGGLKKDATDFEWSFWMEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 48855 - protein, 430 aa, Homo sapiens
MEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 48856 - protein, 700 aa, Homo sapiens
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKGGDERGLLSLAFHPNYKKNGKLYVSYTTNQERWAIGPHDHILRVVEYTVSRKNPHQVDLRTARVFLEVAELHRKHLGGQLLFGPDGFLYIILGDGMITLDDMEEMDGLSDFTGSVLRLDVDTDMCNVPYSIPRSNPHFNSTNQPPEVFAHGLHDPGRCAVDRHPTDININLTILCSDSNGKNRSSARILQIIKGKDYESEPSLLEFKPFSNGPLVGGFVYRGCQSERLYGSYVFGDRNGNFLTLQQSPVTKQWQEKPLCLGTSGSCRGYFSGHILGFGEDELGEVYILSSSKSMTQTHNGKLYKIVDPKRPLMPEECRATVQPAQTLTSECSRLCRNGYCTPTGKCCCSPGWEGDFCRTAKCEPACRHGGVCVRPNKCLCKKGYLGPQCEQVDRNIRRVTRAGILDQIIDMTSYLLDLTSYIV

SEQ ID NO: 48857 - protein, 320 aa, Homo sapiens
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKVGFLNFIYFCAGYVNFILVLPSSLKVFLCNKRKNLAGENKGAT

SEQ ID NO: 48858 - protein, 1381 aa, Homo sapiens
MASPRASRWPPPLLLLLLPLLLLPPAAPGTRDPPPSPARRALSLAPLAGAGLELQLERRPEREPPPTPPRERRGPATPGPSYRAPEPGAATQRGPSGRAPRGGSADAAWKHWPESNTEAHVENITFYQNQEDFSTVSSKEGVMVQTSGKSHAASDAPENLTLLAETADARGRSGSSSRTNFTILPVGYSLEIATALTSQSGNLASESLHLPSSSSEFDERIAAFQTKSGTASEMGTERAMGLSEEWTVHSQEATTSAWSPSFLPALEMGELTTPSRKRNSSGPDLSWLHFYRTAASSPLLDLSSSSESTEKLNNSTGLQSSSVSQTKTMHVATVFTDGGPRTLRSLTVSLGPVSKTEGFPKDSRIATTSSSVLLSPSAVESRRNSRVTGNPGDEEFIEPSTENEFGLTSLRWQNDSPTFGEHQLASSSEVQNGSPMSQTETVSRSVAPMRGGEITAHWLLTNSTTSADVTGSSASYPEGVNASVLTQFSDSTVQSGGSHTALGDRSYSESSSTSSSESLNSSAPRGERSIAGISYGQVRGTAIEQRTSSDHTDHTYLSSTFTKGERALLSITDNSSSSDIVESSTSYIKISNSSHSEYSSFFHAQTERSNISSYDGEYAQPSTESPVLHTSNLPSYTPTINMPNTSVVLDTDAEFVSDSSSSSSSSSSSSSSGPPLPLPSVSQSHHLFSSILPSTRASVHLLKSTSDASTPWSSSPSPLPVSLTTSTSAPLSVSQTTLPQSSSTPVLPRARETPVTSFQTSTMTSFMTMLHSSQTADLKSQSTPHQEKVITESKSPSLVSLPTESTKAVTTNSPLPPSLTESSTEQTLPATSTNLAQMSPTFTTTILKTSQPLMTTPGTLSSTASLVTGPIAVQTTAGKQLSLTHPEILVPQISTEGGISTERNRVIVDATTGLIPLTSVPTSAKEMTTKLGVTAEYSPASRSLGTSPSPQTTVVSTAEDLAPKSATFAVQSSTQSPTTVSSSASVNSCAVNPCLHNGECVADNTSRGYHCRCPPSWQGDDCSVDVNECLSNPCPSTAMCNNTQGSFICKCPVGYQLEKGICNLVRTFVTEFKLKRTFLNTTVEKHSDLQEVENEITKTLNMCFSALPSYIRSTVHASRESNAVVISLQTTFSLASNVTLFDLADRMQKCVNSCKSSAEVCQLLGSQRRIFRAGSLCKRKSPECDKDTSICTDLDGVALCQCKSGYFQFNKMDHSCRACEDGYRLENETCMSCPFGLGGLNCGNPYQLITVVIAAAGGGLLLILGIALIVTCCRKNKNDISKLIFKSGDFQMSPYAEYPKNPRSQEWGREAIEMHENGSTKNLLQMTDVYYSPTSVRNPELERNGLYPAYTGLPGSRHSCIFPGQYNPSFISDESRRRDYF

SEQ ID NO: 48859 - protein, 1942 aa, Homo sapiens
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETETATSNALSGYHVEDLDEGSCNGWHFRPPPRGITSSEEYTLCKRFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYIFLRLSRECCEELNLRPDCDTQVELQFQLNRLPLCEMHYALDRIKDNGVLFPDISMTPTIPWSPNRQWDEQLDPRLNAKQKEAVLAITTPLAIQLPPVLIIGPYGTGKTFTLAQAVKHILQQQETRILICTHSNSAADLYIKDYLHPYVEAGNPQARPLRVYFRNRWVKTVHPVVHQYCLISSAHSTFQMPQKEDILKHRVVVVTLNTSQYLCQLDLEPGFFTHILLDEAAQAMECETIMPLALATQNTRIVLAGDHMQLSPFVYSEFARERNLHVSLLDRLYEHYPAEFPCRILLCENYRSHEAIINYTSELFYEGKLMASGKQPAHKDFYPLTFFTARGEDVQEKNSTAFYNNAEVFEVVERVEELRRKWPVAWGKLDDGSIGVVTPYADQVFRIRAELRKKRLSDVNVERVLNVQGKQFRVLFLSTVRTRHTCKHKQTPIKKKEQLLEDSTEDLDYGFLSNYKLLNTAITRAQSLVAVVGDPIALCSIGRCRKFWERFIALCHENSSLHGITFEQIKAQLEALELKKTYVLNPLAPEFIPRALRLQHSGSTNKQQQSPPKGKSLHHTQNDHFQNDGIVQPNPSVLIGNPIRAYTPPPPLGPHPNLGKSPSPVQRIDPHTGTSILYVPAVYGGNVVMSVPLPVPWTGYQGRFAVDPRIITHQAAMAYNMNLLQTHGRGSPIPYGLGHHPPVTIGQPQNQHQEKDQHEQNRNGKSDTNNSGPEINKIRTPEKKPTEPKQVDLESNPQNRSPESRPSVVYPSTKFPRKDNLNPRHINLPLPAPHAQYAIPNRHFHPLPQLPRPPFPIPQQHTLLNQQQNNLPEQPNQIPPQPNQVVQQQSQLNQQPQQPPPQLSPAYQAGPNNAFFNSAVAHRPQSPPAEAVIPEQQPPPMLQEGHSPLRAIAQPGPILPSHLNSFIDENPSGLPIGEALDRIHGSVALETLRQQQARFQQWSEHHAFLSQGSAPYPHHHHPHLQHLPQPPLGLHQPPVRADWKLTSSAEDEVETTYSRFQDLIRELSHRDQSETRELAEMPPPQSRLLQYRQVQSRSPPAVPSPPSSTDHSSHFSNFNDNSRDIEVASNPAFPQRLPPQIFNSPFSLPSEHLAPPPLKYLAPDGAWTFANLQQNHLMGPGFPYGLPPLPHRPPQNPFVQIQNHQHAIGQEPFHPLSSRTVSSSSLPSLEEYEPRGPGRPLYQRRISSSSVQPCSEEVSTPQDSLAQCKELQDHSNQSSFNFSSPESWVNTTSSTPYQNIPCNGSSRTAQPRELIAPPKTVKPPEDQLKSENLEVSSSFNYSVLQHLGQFPPLMPNKQIAESANSSSPQSSAGGKPAMSYASALRAPPKPRPPPEQAKKSSDPLSLFQELSLGSSSGSNGFYSYFK

SEQ ID NO: 48860 - protein, 454 aa, Homo sapiens
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETETATSNALSGYHVEDLDEGSCNGWHFRPPPRGITSSEEYTLCKRFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSEKKKKKKKKKKKKKKKK

SEQ ID NO: 48861 - protein, 97 aa, Homo sapiens
MPAERPAGSGGSEAPAMVEQLDTAVITPAMLEEEEQLEAAGLERERKMLEKARMSWDRESTEIRYRRLQHLLEKSNIYSKFLLTKMEQQQLETVMKI

SEQ ID NO: 48862 - protein, 838 aa, Homo sapiens
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQHCYWKYLIVDEGHRIKNMKCRLIRELKRFNADNKLLLTGTPLQNNLSELWSLLNFLLPDVFDDLKSFESWFDITSLSETAEDIIAKEREQNVLHMLHQILTPFLLRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPECLF

SEQ ID NO: 48863 - protein, 884 aa, Homo sapiens
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQHCYWKYLIVDEGHRIKNMKCRLIRELKRFNADNKLLLTGTPLQNNLSELWSLLNFLLPDVFDDLKSFESWFDITSLSETAEDIIAKEREQNVLHMLHQERIPRMYVSEFTDEGFFEGKLPSRKDLYDIRPYENTYLLKLHTNFEILTPFLLRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPECLF

SEQ ID NO: 48864 - protein, 129 aa, Homo sapiens
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPGNFVCG

SEQ ID NO: 48865 - protein, 315 aa, Homo sapiens
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLIYL

SEQ ID NO: 48866 - protein, 740 aa, Homo sapiens
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQPVPFQQPKHFTGGVMRWYQVEGMEWLRMLWENGINGILADEMGLGKTVQCIATIALMIQRGVPGPFLVCGPLSTLPNWMAEFKRFTPDIPTMLYHGTQEERQKLVRNIYKRKGTLQIHPVVITSFEIAMRDRNALQILTPFLLRRLKSDVALEVPPKREVVVYAPLSKKQEIFYTAIVNRTIANMFGSSEKETIELSPTGRPKRRTRKSINYSKIDDFPNELEKLISQIQPEVDRERAVVEVNIPVESEVNLKLQNIMMLLRKCCNHPYLIEYPIDPVTQEFKIDEELVTNSGKFLILDRMLPELKKRGHKVLLFSQMTSMLDILMDYCHLRDFNFSRLDGSMSYSEREKNMHSFNTDPEVFIFLVSTRAGGLGINLTAADTVIIYDSDWNPQSDLQAQDRCHRIGQTKPVVVYRLVTANTIDQKIVERAAAKRKLEKLIIHKNHFKGGQSGLNLSKNFLDPKELMELLKSRDYEREIKGSREKVISDKDLELLLDRSDLIDQMNASGPIKEKMGIFKILENSEDSSPECLF

SEQ ID NO: 48867 - protein, 192 aa, Homo sapiens
MVEQLDTAVITPAMLEEEEQLEAAGLERERKMLEKARMSWDRESTEIRYRRLQHLLEKSNIYSKFLLTKMEQQQLEEQKKKEKLERKKESLKVKKGKNSIDASEEKPVMRKKRGREDESYNISEVMSKEEILSVAKKNKKENEDENSSSTNLCVEDLQKNKDSNSIIKDRLSETVRQNTKFFFDPVRKCNGQ

SEQ ID NO: 48868 - protein, 486 aa, Homo sapiens
MWKSVVGHDVSVSVETQGDDWDTDPDFVNDISEKEQRWGAKTIEGSGRTEHINIHQLRNKVSEEHDVLRKKEMESGPKASHGYGGRFGVERDRMDKSAVGHEYVAEVEKHSSQTDAAKGFGGKYGVERDRADKSAVGFDYKGEVEKHTSQKDYSRGFGGRYGVEKDKWDKAALGYDYKGETEKHESQRDYAKGFGGQYGIQKDRVDKSAVGFNEMEAPTTAYKKTTPIEAASSGTRGLKAKFESMAEEKRKREEEEKAQQVARRQQERKAVTKRSPEAPQPVIAMEEPAVPAPLPKKISSEAWPPVGTPPSSESEPVRTSREHPVPLLPIRQTLPEDNEEPPALPPRTLEGLQVEEEPVYEAEPEPEPEPEPEPENDYEDVEEMDRHEQEDEPEGDYEEVLEPEDSSFSSALAGSSGCPAGAGAGAVALGISAVAVYDYQGEGSDELSFDPDDVITDIEMVDEGWWRGRCHGHFGLFPANYVKLLE

SEQ ID NO: 48869 - protein, 199 aa, Homo sapiens
MPNYKLTYFNMRGRAEIIRYIFAYLDIQYEDHRIEQADWPEIKSTLPFGKIPILEVDGLTLHQSLAIARYLTKNTDLAGNTEMEQCHVDAIVDTLDDFMSCFPWAEKKQDVKEQMFNELLTYNAPHLMQDLDTYLGGREWLIGNSVTWADFYWEICSTTLLVFKPDLLDNHPRLVTLRKKVQAIPAVANWIKRRPQTKL

SEQ ID NO: 48870 - protein, 270 aa, Homo sapiens
MQYPHPGPAAGAVGVPLYAPTPLLQPAHPTPFYIEDILGRGPAAPTPAPTLPSPNSSFTSLVSPYRTPVYEPTPIHPAFSHHSAAALAAAYGPGGFGGPLYPFPRTVNDYTHALLRHDPLGKPLLWSPFLQRPLHKRKGGQVRFSNDQTIELEKKFETQKYLSPPERKRLAKMLQLSERQVKTWFQNRRAKWRRLKQENPQSNKKEELESLDSSCDQRQDLPSEQNKGASLDSSQCSPSPASQEDLESEISEDSDQEVDIEGDKSYFNAG

SEQ ID NO: 48871 - protein, 189 aa, Homo sapiens
MLGMIKNSLFGSVETWPWQVLSKGDKEEVAYEERACEGGKFATVEVTDKPVDEALREAMPKVAKYAGGTNDKGIGMGMTVPISFAVFPNEDGSLQKKLKVWFRIPNQFQSDPPAPSDKSVKIEEREGITVYSMQFGGYAKEADYVAQATRLRAALEGTATYRGDIYFCTGYDPPMKPYGRRNEIWLLKT

SEQ ID NO: 48872 - protein, 316 aa, Homo sapiens
MSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 48873 - protein, 316 aa, Homo sapiens; identical to SEQ ID NO: 48872

SEQ ID NO: 48874 - protein, 316 aa, Homo sapiens; identical to SEQ ID NO: 48872

SEQ ID NO: 48875 - protein, 316 aa, Homo sapiens; identical to SEQ ID NO: 48872

SEQ ID NO: 48876 - protein, 316 aa, Homo sapiens; identical to SEQ ID NO: 48872

SEQ ID NO: 48877 - protein, 316 aa, Homo sapiens; identical to SEQ ID NO: 48872

SEQ ID NO: 48878 - protein, 5635 aa, Homo sapiens
MISWEVVHTVFLFALLYSSLAQDASPQSEIRAEEIPEGASTLAFVFDVTGSMYDDLVQVIEGASKILETSLKRPKRPLFNFALVPFHDPEIGPVTITTDPKKFQYELRELYVQGGGDCPEMSIGAIKIALEISLPGSFIYVFTDARSKDYRLTHEVLQLIQQKQSQVVFVLTGDCDDRTHIGYKVYEEIASTSSGQVFHLDKKQVNEVLKWVEEAVQASKVHLLSTDHLEQAVNTWRIPFDPSLKEVTVSLSGPSPMIEIRNPLGKLIKKGFGLHELLNIHNSAKVVNVKEPEAGMWTVKTSSSGRHSVRITGLSTIDFRAGFSRKPTLDFKKTVSRPVQGIPTYVLLNTSGISTPARIDLLELLSISGSSLKTIPVKYYPHRKPYGIWNISDFVPPNEAFFLKVTGYDKDDYLFQRVSSVSFSSIVPDAPKVTMPEKTPGYYLQPGQIPCSVDSLLPFTLSFVRNGVTLGVDQYLKESASVNLDIAKVTLSDEGFYECIAVSSAGTGRAQTFFDVSEPPPVIQVPNNVTVTPGERAVLTCLIISAVDYNLTWQRNDRDVRLAEPARIRTLANLSLELKSVKFNDAGEYHCMVSSEGGSSAASVFLTVQEPPKVTVMPKNQSFTGGSEVSIMCSATGYPKPKIAWTVNDMFIVGSHRYRMTSDGTLFIKNAAPKDAGIYGCLASNSAGTDKQNSTLRYIEAPKLMVVQSELLVALGDITVMECKTSGIPPPQVKWFKGDLELRPSTFLIIDPLLGLLKIQETQDLDAGDYTCVAINEAGRATGKITLDVGSPPVFIQEPADVSMEIGSNVTLPCYVQGYPEPTIKWRRLDNMPIFSRPFSVSSISQLRTGALFILNLWASDKGTYICEAENQFGKIQSETTVTVTGLVAPLIGISPSVANVIEGQQLTLPCTLLAGNPIPERRWIKNSAMLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPGGEESGEYVCTATNTAGYAKRKVQLTVYVRPRVFGDQRGLSQDKPVEISVLAGEEVTLPCEVKSLPPPIITWAKETQLISPFSPRHTFLPSGSMKITETRTSDSGMYLCVATNIAGNVTQAVKLNVHVPPKIQRGPKHLKVQVGQRVDIPCNAQGTPLPVITWSKGGSTMLVDGEHHVSNPDGTLSIDQATPSDAGIYTCVATNIAGTDETEITLHVQEPPTVEDLEPPYNTTFQERVANQRIEFPCPAKGTPKPTIKWLHNGRELTGREPGISILEDGTLLVIASVTPYDNGEYICVAVNEAGTTERKYNLKVHVPPVIKDKEQVTNVSVLLNQLTNLFCEVEGTPSPIIMWYKDNVQVTESSTIQTVNNGKILKLFRATPEDAGRYSCKAINIAGTSQKYFNIDVLVPPTIIGTNFPNEVSVVLNRDVALECQVKGTPFPDIHWFKDGKPLFLGDPNVELLDRGQVLHLKNARRNDKGRYQCTVSNAAGKQAKDIKLTIYIPPSIKGGNVTTDISVLINSLIKLECETRGLPMPAITWYKDGQPIMSSSQALYIDKGQYLHIPRAQVSDSATYTCHVANVAGTAEKSFHVDVYVPPMIEGNLATPLNKQVVIAHSLTLECKAAGNPSPILTWLKDGVPVKANDNIRIEAGGKKLEIMSAQEIDRGQYICVATSVAGEKEIKYEVDVLVPPAIEGGDETSYFIVMVNNLLELDCHVTGSPPPTIMWLKDGQLIDERDGFKILLNGRKLVIAQAQVSNTGLYRCMAANTAGDHKKEFEVTVHVPPTIKSSGLSERVVVKYKPVALQCIANGIPNPSITWLKDDQPVNTAQGNLKIQSSGRVLQIAKTLLEDAGRYTCVATNAAGETQQHIQLHVHEPPSLEDAGKMLNETVLVSNPVQLECKAAGNPVPVITWYKDNRLLSGSTSMTFLNRGQIIDIESAQISDAGIYKCVAINSAGATELFYSLQVHVAPSISGSNNMVAVVVNNPVRLECEARGIPAPSLTWLKDGSPVSSFSNGLQVLSGGRILALTSAQISDTGRYTCVAVNAAGEKQRDIDLRVYVPPNIMGEEQNVSVLISQAVELLCQSDAIPPPTLTWLKDGHPLLKKPGLSISENRSVLKIEDAQVQDTGRYTCEATNVAGKTEKNYNVNIWVPPNIGGSDELTQLTVIEGNLISLLCESSGIPPPNLIWKKKGSPVLTDSMGRVRILSGGRQLQISIAEKSDAALYSCVASNVAGTAKKEYNLQVYIRPTITNSGSHPTEIIVTRGKSISLECEVQGIPPPTVTWMKDGHPLIKAKGVEILDEGHILQLKNIHVSDTGRYVCVAVNVAGMTDKKYDLSVHAPPSIIGNHRSPENISVVEKNSVSLTCEASGIPLPSITWFKDGWPVSLSNSVRILSGGRMLRLMQTTMEDAGQYTCVVRNAAGEERKIFGLSVLVPPHIVGENTLEDVKVKEKQSVTLTCEVTGNPVPEITWHKDGQPLQEDEAHHIISGGRFLQITNVQVPHTGRYTCLASSPAGHKSRSFSLNVFVSPTIAGVGSDGNPEDVTVILNSPTSLVCEAYSYPPATITWFKDGTPLESNRNIRILPGGRTLQILNAQEDNAGRYSCVATNEAGEMIKHYEVKVYIPPIINKGDLWGPGLSPKEVKIKVNNTLTLECEAYAIPSASLSWYKDGQPLKSDDHVNIAANGHTLQIKEAQISDTGRYTCVASNIAGEDELDFDVNIQVPPSFQKLWEIGNMLDTGRNGEAKDVIINNPISLYCETNAAPPPTLTWYKDGHPLTSSDKVLILPGGRVLQIPRAKVEDAGRYTCVAVNEAGEDSLQYDVRVLVPPIIKGANSDLPEEVTVLVNKSALIECLSSGSPAPRNSWQKDGQPLLEDDHHKFLSNGRILQILNTQITDIGRYVCVAENTAGSAKKYFNLNVHVPPSVIGPKSENLTVVVNNFISLTCEVSGFPPPDLSWLKNEQPIKLNTNTLIVPGGRTLQIIRAKVSDGGEYTCIAINQAGESKKKFSLTVYVPPSIKDHDSESLSVVNVREGTSVSLECESNAVPPPVITWYKNGRMITESTHVEILADGQMLHIKKAEVSDTGQYVCRAINVAGRDDKNFHLNVYVPPSIEGPEREVIVETISNPVTLTCDATGIPPPTIAWLKNHKRIENSDSLEVRILSGGSKLQIARSQHSDSGNYTCIASNMEGKAQKYYFLSIQVPPSVAGAEIPSDVSVLLGENVELVCNANGIPTPLIQWLKDGKPIASGETERIRVSANGSTLNIYGALTSDTGKYTCVATNPAGEEDRIFNLNVYVTPTIRGNKDEAEKLMTLVDTSINIECRATGTPPPQINWLKNGLPLPLSSHIRLLAAGQVIRIVRAQVSDVAVYTCVASNRAGVDNKHYNLQVFAPPNMDNSMGTEEITVLKGSSTSMACITDGTPAPSMAWLRDGQPLGLDAHLTVSTHGMVLQLLKAETEDSGKYTCIASNEAGEVSKHFILKVLEPPHINGSEEHEEISVIVNNPLELTCIASGIPAPKMTWMKDGRPLPQTDQVQTLGGGEVLRISTAQVEDTGRYTCLASSPAGDDDKEYLVRVHVPPNIAGTDEPRDITVLRNRQVTLECKSDAVPPPVITWLRNGERLQATPRVRILSGGRYLQINNADLGDTANYTCVASNIAGKTTREFILTVNVPPNIKGGPQSLVILLNKSTVLECIAEGVPTPRITWRKDGAVLAGNHARYSILENGFLHIQSAHVTDTGRYLCMATNAAGTDRRRIDLQVHVPPSIAPGPTNMTVIVNVQTTLACEATGIPKPSINWRKNGHLLNVDQNQNSYRLLSSGSLVIISPSVDDTATYECTVTNGAGDDKRTVDLTVQVPPSIADEPTDFLVTKHAPAVITCTASGVPFPSIHWTKNGIRLLPRGDGYRILSSGAIEILATQLNHAGRYTCVARNAAGSAHRHVTLHVHEPPVIQPQPSELHVILNNPILLPCEATGTPSPFITWQKEGINVNTSGRNHAVLPSGGLQISRAVREDAGTYMCVAQNPAGTALGKIKLNVQVPPVISPHLKEYVIAVDKPITLSCEADGLPPPDITWHKDGRAIVESIRQRVLSSGSLQIAFVQPGDAGHYTCMAANVAGSSSTSTKLTVHVPPRIRSTEGHYTVNENSQAILPCVADGIPTPAINWKKDNVLLANLLGKYTAEPYGELILENVVLEDSGFYTCVANNAAGEDTHTVSLTVHVLPTFTELPGDVSLNKGEQLRLSCKATGIPLPKLTWTFNNNIIPAHFDSVNGHSELVIERVSKEDSGTYVCTAENSVGFVKAIGFVYVKEPPVFKGDYPSNWIEPLGGNAILNCEVKGDPTPTIQWNRKGVDIEISHRIRQLGNGSLAIYGTVNEDAGDYTCVATNEAGVVERSMSLTLQSPPIITLEPVETVINAGGKIILNCQATGEPQPTITWSRQGHSISWDDRVNVLSNNSLYIADAQKEDTSEFECVARNLMGSVLVRVPVIVQVHGGFSQWSAWRACSVTCGKGIQKRSRLCNQPLPANGGKPCQGSDLEMRNCQNKPCPVDGSWSEWSLWEECTRSCGRGNQTRTRTCNNPSVQHGGRPCEGNAVEIIMCNIRPCPVHGAWSAWQPWGTCSESCGKGTQTRARLCNNPPPAFGGSYCDGAETQMQVCNERNCPIHGKWATWASWSACSVSCGGGARQRTRGCSDPVPQYGGRKCEGSDVQSDFCNSDPCPTHGNWSPWSGWGTCSRTCNGGQMRRYRTCDNPPPSNGGRACGGPDSQIQRCNTDMCPVDGSWGSWHSWSQCSASCGGGEKTRKRLCDHPVPVKGGRPCPGDTTQVTRCNVQACPGGPQRARGSVIGNINDVEFGIAFLNATITDSPNSDTRIIRAKITNVPRSLGSAMRKIVSILNPIYWTTAKEIGEAVNGFTLTNAVFKRETQVEFATGEILQMSHIARGLDSDGSLLLDIVVSGYVLQLQSPAEVTVKDYTEDYIQTGPGQLYAYSTRLFTIDGISIPYTWNHTVFYDQAQGRMPFLVETLHASSVESDYNQIEETLGFKIHASISKGDRSNQCPSGFTLDSVGPFCADEDECAAGNPCSHSCHNAMGTYYCSCPKGLTIAADGRTCQDIDECALGRHTCHAGQDCDNTIGSYRCVVRCGSGFRRTSDGLSCQDINECQESSPCHQRCFNAIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDINECEQVPKPCAHQCSNTPGSFKCICPPGQHLLGDGKSCAGLERLPNYGTQYSSYNLARFSPVRNNYQPQQHYRQYSHLYSSYSEYRNSRTSLSRTRRTIRKTCPEGSEASHDTCVDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHPRTTFLMVDEEQTVPFALRDENLKGVVYTTRPLREAETYRMRVRASSYSANGTIEYQTTFIVYIAVSAYPY

SEQ ID NO: 48879 - protein, 5518 aa, Homo sapiens
MISWEVVHTVFLFALLYSSLAQDASPQSEIRAEEIPEGASTLAFVFDVTGSMYDDLVQVIEGASKILETSLKRPKRPLFNFALVPFHDPEIGPVTITTDPKKFQYELRELYVQGGGDCPEMSIGAIKIALEISLPGSFIYVFTDARSKDYRLTHEVLQLIQQKQSQVVFVLTGDCDDRTHIGYKVYEEIASTSSGQVFHLDKKQVNEVLKWVEEAVQASKVHLLSTDHLEQAVNTWRIPFDPSLKEVTVSLSGPSPMIEIRNPLGKLIKKGFGLHELLNIHNSAKVVNVKEPEAGMWTVKTSSSGRHSVRITGLSTIDFRAGFSRKPTLDFKKTVSRPVQGIPTYVLLNTSGISTPARIDLLELLSISGSSLKTIPVKYYPHRKPYGIWNISDFVPPNEAFFLKVTGYDKDDYLFQRVSSVSFSSIVPDAPKVTMPEKTPGYYLQPGQIPCSVDSLLPFTLSFVRNGVTLGVDQYLKESASVNLDIAKVTLSDEGFYECIAVSSAGTGRAQTFFDVSEPPPVIQVPNNVTVTPGERAVLTCLIISAVDYNLTWQRNDRDVRLAEPARIRTLANLSLELKSVKFNDAGEYHCMVSSEGGSSAASVFLTVQEPPKVTVMPKNQSFTGGSEVSIMCSATGYPKPKIAWTVNDMFIVGSHRYRMTSDGTLFIKNAAPKDAGIYGCLASNSAGTDKQNSTLRYIEAPKLMVVQSELLVALGDITVMECKTSGIPPPQVKWFKGDLELRPSTFLIIDPLLGLLKIQETQDLDAGDYTCVAINEAGRATGKITLDVGSPPVFIQEPADVSMEIGSNVTLPCYVQGYPEPTIKWRRLDNMPIFSRPFSVSSISQLRTGALFILNLWASDKGTYICEAENQFGKIQSETTVTVTGLVAPLIGISPSVANVIEGQQLTLPCTLLAGNPIPERRWIKNSAMLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPGGEESGEYVCTATNTAGYAKRKVQLTVYVRPRVFGDQRGLSQDKPVEISVLAGEEVTLPCEVKSLPPPIITWAKETQLISPFSPRHTFLPSGSMKITETRTSDSGMYLCVATNIAGNVTQAVKLNVHVPPKIQRGPKHLKVQVGQRVDIPCNAQGTPLPVITWSKGGSTMLVDGEHHVSNPDGTLSIDQATPSDAGIYTCVATNIAGTDETEITLHVQEPPTVEDLEPPYNTTFQERVANQRIEFPCPAKGTPKPTIKWLHNGRELTGREPGISILEDGTLLVIASVTPYDNGEYICVAVNEAGTTERKYNLKVHVPPVIKDKEQVTNVSVLLNQLTNLFCEVEGTPSPIIMWYKDNVQVTESSTIQTVNNGKILKLFRATPEDAGRYSCKAINIAGTSQKYFNIDVLVPPTIIGTNFPNEVSVVLNRDVALECQVKGTPFPDIHWFKDGKPLFLGDPNVELLDRGQVLHLKNARRNDKGRYQCTVSNAAGKQAKDIKLTIYIPPSIKGGNVTTDISVLINSLIKLECETRGLPMPAITWYKDGQPIMSSSQALYIDKGQYLHIPRAQVSDSATYTCHVANVAGTAEKSFHVDVYVPPMIEGNLATPLNKQVVIAHSLTLECKAAGNPSPILTWLKDGVPVKANDNIRIEAGGKKLEIMSAQEIDRGQYICVATSVAGEKEIKYEVDVLVPPAIEGGDETSYFIVMVNNLLELDCHVTGSPPPTIMWLKDGQLIDERDGFKILLNGRKLVIAQAQVSNTGLYRCMAANTAGDHKKEFEVTVHVPPTIKSSGLSERVVVKYKPVALQCIANGIPNPSITWLKDDQPVNTAQGNLKIQSSGRVLQIAKTLLEDAGRYTCVATNAAGETQQHIQLHVHEPPSLEDAGKMLNETVLVSNPVQLECKAAGNPVPVITWYKDNRLLSGSTSMTFLNRGQIIDIESAQISDAGIYKCVAINSAGATELFYSLQVHVAPSISGSNNMVAVVVNNPVRLECEARGIPAPSLTWLKDGSPVSSFSNGLQVLSGGRILALTSAQISDTGRYTCVAVNAAGEKQRDIDLRVYVPPNIMGEEQNVSVLISQAVELLCQSDAIPPPTLTWLKDGHPLLKKPGLSISENRSVLKIEDAQVQDTGRYTCEATNVAGKTEKNYNVNIWVPPNIGGSDELTQLTVIEGNLISLLCESSGIPPPNLIWKKKGSPVLTDSMGRVRILSGGRQLQISIAEKSDAALYSCVASNVAGTAKKEYNLQVYIRPTITNSGSHPTEIIVTRGKSISLECEVQGIPPPTVTWMKDGHPLIKAKGVEILDEGHILQLKNIHVSDTGRYVCVAVNVAGMTDKKYDLSVHAPPSIIGNHRSPENISVVEKNSVSLTCEASGIPLPSITWFKDGWPVSLSNSVRILSGGRMLRLMQTTMEDAGQYTCVVRNAAGEERKIFGLSVLVPPHIVGENTLEDVKVKEKQSVTLTCEVTGNPVPEITWHKDGQPLQEDEAHHIISGGRFLQITNVQVPHTGRYTCLASSPAGHKSRSFSLNVFVSPTIAGVGSDGNPEDVTVILNSPTSLVCEAYSYPPATITWFKDGTPLESNRNIRILPGGRTLQILNAQEDNAGRYSCVATNEAGEMIKHYEVKVYIPPIINKGDLWGPGLSPKEVKIKVNNTLTLECEAYAIPSASLSWYKDGQPLKSDDHVNIAANGHTLQIKEAQISDTGRYTCVASNIAGEDELDFDVNIQVPPSFQKLWEIGNMLDTGRNGEAKDVIINNPISLYCETNAAPPPTLTWYKDGHPLTSSDKVLILPGGRVLQIPRAKVEDAGRYTCVAVNEAGEDSLQYDVRVLVPPIIKGANSDLPEEVTVLVNKSALIECLSSGSPAPRNSWQKDGQPLLEDDHHKFLSNGRILQILNTQITDIGRYVCVAENTAGSAKKYFNLNVHVPPSVIGPKSENLTVVVNNFISLTCEVSGFPPPDLSWLKNEQPIKLNTNTLIVPGGRTLQIIRAKVSDGGEYTCIAINQAGESKKKFSLTVYVPPSIKDHDSESLSVVNVREGTSVSLECESNAVPPPVITWYKNGRMITESTHVEILADGQMLHIKKAEVSDTGQYVCRAINVAGRDDKNFHLNVYVPPSIEGPEREVIVETISNPVTLTCDATGIPPPTIAWLKNHKRIENSDSLEVRILSGGSKLQIARSQHSDSGNYTCIASNMEGKAQKYYFLSIQVPPSVAGAEIPSDVSVLLGENVELVCNANGIPTPLIQWLKDGKPIASGETERIRVSANGSTLNIYGALTSDTGKYTCVATNPAGEEDRIFNLNVYVTPTIRGNKDEAEKLMTLVDTSINIECRATGTPPPQINWLKNGLPLPLSSHIRLLAAGQVIRIVRAQVSDVAVYTCVASNRAGVDNKHYNLQVFAPPNMDNSMGTEEITVLKGSSTSMACITDGTPAPSMAWLRDGQPLGLDAHLTVSTHGMVLQLLKAETEDSGKYTCIASNEAGEVSKHFILKVLEPPHINGSEEHEEISVIVNNPLELTCIASGIPAPKMTWMKDGRPLPQTDQVQTLGGGEVLRISTAQVEDTGRYTCLASSPAGDDDKEYLVRVHVPPNIAGTDEPRDITVLRNRQVTLECKSDAVPPPVITWLRNGERLQATPRVRILSGGRYLQINNADLGDTANYTCVASNIAGKTTREFILTVNVPPNIKGGPQSLVILLNKSTVLECIAEGVPTPRITWRKDGAVLAGNHARYSILENGFLHIQSAHVTDTGRYLCMATNAAGTDRRRIDLQVHVPPSIAPGPTNMTVIVNVQTTLACEATGIPKPSINWRKNGHLLNVDQNQNSYRLLSSGSLVIISPSVDDTATYECTVTNGAGDDKRTVDLTVQVPPSIADEPTDFLVTKHAPAVITCTASGVPFPSIHWTKNGIRLLPRGDGYRILSSGAIEILATQLNHAGRYTCVARNAAGSAHRHVTLHVHEPPVIQPQPSELHVILNNPILLPCEATGTPSPFITWQKEGINVNTSGRNHAVLPSGGLQISRAVREDAGTYMCVAQNPAGTALGKIKLNVQVPPVISPHLKEYVIAVDKPITLSCEADGLPPPDITWHKDGRAIVESIRQRVLSSGSLQIAFVQPGDAGHYTCMAANVAGSSSTSTKLTVHVPPRIRSTEGHYTVNENSQAILPCVADGIPTPAINWKKDNVLLANLLGKYTAEPYGELILENVVLEDSGFYTCVANNAAGEDTHTVSLTVHVLPTFTELPGDVSLNKGEQLRLSCKATGIPLPKLTWTFNNNIIPAHFDSVNGHSELVIERVSKEDSGTYVCTAENSVGFVKAIGFVYVKEPPVFKGDYPSNWIEPLGGNAILNCEVKGDPTPTIQWNRKGVDIEISHRIRQLGNGSLAIYGTVNEDAGDYTCVATNEAGVVERSMSLTLQSPPIITLEPVETVINAGGKIILNCQATGEPQPTITWSRQGHSISWDDRVNVLSNNSLYIADAQKEDTSEFECVARNLMGSVLVRVPVIVQVHGGFSQWSAWRACSVTCGKGIQKRSRLCNQPLPANGGKPCQGSDLEMRNCQNKPCPVDGSWSEWSLWEECTRSCGRGNQTRTRTCNNPSVQHGGRPCEGNAVEIIMCNIRPCPVHGAWSAWQPWGTCSESCGKGTQTRARLCNNPPPAFGGSYCDGAETQMQVCNERNCPIHGKWATWASWSACSVSCGGGARQRTRGCSDPVPQYGGRKCEGSDVQSDFCNSDPCPTHGNWSPWSGWGTCSRTCNGGQMRRYRTCDNPPPSNGGRACGGPDSQIQRCNTDMCPVDGSWGSWHSWSQCSASCGGGEKTRKRLCDHPVPVKGGRPCPGDTTQVTRCNVQACPGGPQRARGSVIGNINDVEFGIAFLNATITDSPNSDTRIIRAKITNVPRSLGSAMRKIVSILNPIYWTTAKEIGEAVNGFTLTNAVFKRETQVEFATGEILQMSHIARGLDSDGSLLLDIVVSGYVLQLQSPAEVTVKDYTEDYIQTGPGQLYAYSTRLFTIDGISIPYTWNHTVFYDQAQGRMPFLVETLHASSVESDYNQIEETLGFKIHASISKGDRSNQCPSGFTLDSVGPFCADEDECAAGNPCSHSCHNAMGTYYCSCPKGLTIAADGRTCQDIDECALGRHTCHAGQDCDNTIGSYRCVVRCGSGFRRTSDGLSCQDINECQESSPCHQRCFNAIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHPRTTFLMVDEEQTVPFALRDENLKGVVYTTRPLREAETYRMRVRASSYSANGTIEYQTTFIVYIAVSAYPY

SEQ ID NO: 48880 - protein, 240 aa, Homo sapiens
AIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHP

SEQ ID NO: 48881 - protein, 484 aa, Homo sapiens
MDLGKDQSHLKHHQTPDPHQEENHSPEVIGTWSLRNRELLRKRKAEVHEKETSQWLFGEQKKRKQQRTGKGNRRGRKRQQNTELKVEPQPQIEKEIVEKALAPIEKKTEPPGSITKVFPSVASPQKVVPEEHFSEICQESNIYQENFSEYQEIAVQNHSSETCQHVSEPEDLSPKMYQEISVLQDNSSKICQDMKEPEDNSPNTCQVISVIQDHPFKMYQDMAKREDLAPKMCQEAAVPKILPCPTSEDTADLAGCSLQAYPKPDVPKGYILDTDQNPAEPEEYNETDQGIAETEGLFPKIQEIAEPKDLSTKTHQESAEPKYLPHKTCNEIIVPKAPSHKTIQETPHSEDYSIEINQETPGSEKYSPETYQEIPGLEEYSPEIYQETSQLEEYSPEIYQETPGPEDLSTETYKNKDVPKECFPEPHQETGGPQGQDPKAHQEDAKDAYTFPQEMKEKPKEEPGIPAILNESHPENDVYSYVLF

SEQ ID NO: 48882 - protein, 484 aa, Homo sapiens; identical to SEQ ID NO: 48881

SEQ ID NO: 48883 - protein, 142 aa, Homo sapiens
MVLSPADKTNVKAAWGKVGAHAGEYGAEALERMFLSFPTTKTYFPHFDLSHGSAQVKGHGKKVADALTNAVAHVDDMPNALSALSDLHAHKLRVDPVNFKLLSHCLLVTLAAHLPAEFTPAVHASLDKFLASVSTVLTSKYR

SEQ ID NO: 48884 - protein, 142 aa, Homo sapiens; identical to SEQ ID NO: 48883

SEQ ID NO: 48885 - protein, 110 aa, Homo sapiens
MFLSFPTTKTYFPHFDLSHGSAQVKGHGKKVADALTNAVAHVDDMPNALSALSDLHAHKLRVDPVNFKLLSHCLLVTLAAHLPAEFTPAVHASLDKFLASVSTVLTSKYR

SEQ ID NO: 48886 - protein, 147 aa, Homo sapiens
MVHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGKEFTPPVQAAYQKVVAGVANALAHKYH

SEQ ID NO: 48887 - protein, 90 aa, Homo sapiens
MVHLTPEEKSAVTALWGKVNVDEVGGEALGRLLVVYPWTQRFFESFGDLSTPDAVMGNPKVKAHGKKVLGAFSDGLAHLDNLKGTFATLS

SEQ ID NO: 48888 - protein, 141 aa, Homo sapiens
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRVCKKVPEALQIGSTCLFYKEYMGKEKSKGTVQGING

SEQ ID NO: 48889 - protein, 147 aa, Homo sapiens
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRLLGNVLVCVLARNFGKEFTPQMQAAYQKVVAGVANALAHKYH

SEQ ID NO: 48890 - protein, 104 aa, Homo sapiens
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENF

SEQ ID NO: 48891 - protein, 147 aa, Homo sapiens
MVHFTAEEKAAVTSLWSKMNVEEAGGEALGRLLVVYPWTQRFFDSFGNLSSPSAILGNPKVKAHGKKVLTSFGDAIKNMDNLKPAFAKLSELHCDKLHVDPENFKLLGNVMVIILATHFGKEFTPEVQAAWQKLVSAVAIALAHKYH

SEQ ID NO: 48892 - protein, 147 aa, Homo sapiens; identical to SEQ ID NO: 48891

SEQ ID NO: 48893 - protein, 87 aa, Homo sapiens
MVHFTAEEKAAVTSLWSKMNVEEAGGEALGRLLVVYPWTQRFFDSFGNLSSPSAILGNPKVKAHGKKVLTSFGDAIKNMDNLKPAFA

SEQ ID NO: 48894 - protein, 147 aa, Homo sapiens
MGHFTEEDKATITSLWGKVNVEDAGGETLGRLLVVYPWTQRFFDSFGNLSSASAIMGNPKVKAHGKKVLTSLGDATKHLDDLKGTFAQLSELHCDKLHVDPENFKLLGNVLVTVLAIHFGKEFTPEVQASWQKMVTAVASALSSRYH

SEQ ID NO: 48895 - protein, 147 aa, Homo sapiens
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTGVASALSSRYH

SEQ ID NO: 48896 - protein, 158 aa, Homo sapiens
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMDWSGQCPVLQIPLSSLPMMQSFQG

SEQ ID NO: 48897 - protein, 137 aa, Homo sapiens
MVVLGEMKRKVLPLHFLPFMRLLVVYPWTQRFFDSFGNLSSASAIMGNPKVKAHGKKVLTSLGDAIKHLDDLKGTFAQLSELHCDKLHVDPENFKLLGNVLVTVLAIHFGKEFTPEVQASWQKMVTGVASALSSRYH

SEQ ID NO: 48898 - protein, 147 aa, Homo sapiens; identical to SEQ ID NO: 48895

SEQ ID NO: 48899 - protein, 141 aa, Homo sapiens
MLSAQERAQIAQVWDLIAGHEAQFGAELLLRLFTVYPSTKVYFPHLSACQDATQLLSHGQRMLAAVGAAVQHVDNLRAALSPLADLHALVLRVDPANFPLLIQCFHVVLASHLQDEFTVQMQAAWDKFLTGVAVVLTEKYR

SEQ ID NO: 48900 - protein, 142 aa, Homo sapiens
MALSAEDRALVRALWKKLGSNVGVYTTEALERTFLAFPATKTYFSHLDLSPGSSQVRAHGQKVADALSLAVERLDDLPHALSALSHLHACQLRVDPASFQLLGHCLLVTLARHYPGDFSPALQASLDKFLSHVISALVSEYR

SEQ ID NO: 48901 - protein, 142 aa, Homo sapiens
MSLTKTERTIIVSMWAKISTQADTIGTETLERLFLSHPQTKTYFPHFDLHPGSAQLRAHGSKVVAAVGDAVKSIDDIGGALSKLSELHAYILRVDPVNFKLLSHCLLVTLAARFPADFTAEAHAAWDKFLSVVSSVLTEKYR

SEQ ID NO: 48902 - protein, 462 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 48903 - protein, 254 aa, Homo sapiens [sequence omitted]

SEQ ID NO: 48904 - protein, 450 aa, Homo sapiens
MWLKVFTTFLSFATGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGLEKLAQKGKSLSPLASITGISLFLIISMCLLFLWKKYQPYKVIKQKLEGRPETEYRKAQTFSGHEDALDDFGIYEFVAFPDVSGVSRIPSRSVPASDCVSGQDLHSTVYEVIQHIPAQQQDHPE

SEQ ID NO: 48905 - protein, 462 aa, Homo sapiens
MGQDAFMEPFGDTLGVFQCKIYLLLFGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGLEKLAQKGKSLSPLASITGISLFLIISMCLLFLWKKYQPYKVIKQKLEGRPETEYRKAQTFSGHEDALDDFGIYEFVAFPDVSGVSRIPSRSVPASDCVSGQDLHSTVYEVIQHIPAQQQDHPE

SEQ ID NO: 48906 - protein, 367 aa, Homo sapiens
MAYRVLGRAGPPQPRRARRLLFAFTLSLSCTYLCYSFLCCCDDLGRSRLLGAPRCLRGPSAGGQKLLQKSRPCDPSGPTPSEPSAPSAPAAAVPAPRLSGSNHSGSPKLGTKRLPQALIVGVKKGGTRAVLEFIRVHPDVRALGTEPHFFDRNYGRGLDWYRSLMPRTLESQITLEKTPSYFVTQEAPRRIFNMSRDTKLIVVVRNPVTRAISDYTQTLSKKPDIPTFEGLSFRNRTLGLVDVSWNAIRIGMYVLHLESWLQYFPLAQIHFVSGERLITDPAGEMGRVQDFLGIKRFITDKHFYFNKTKGFPCLKKTESSLLPRCLGKSKGRTHVQIDPEVIDQLREFYRPYNIKFYETVGQDFRWE

SEQ ID NO: 48907 - protein, 344 aa, Homo sapiens
PPARAHGAMAYRVLGRAGPPQPRRARRLLFAFTLSLSCTYLCYSFLCCCDDLGRSRLLGAPRCLRGPSAGGQKLLQKSRPCDPSGPTPSEPSAPSAPAAAVPAPRLSGSNHSGSPKLGTKRLPQALIVGVKKGGTRAVLEFIRVHPDVRALGTEPHFFDRNYGRGLDWYRSLMPRTLESQITLEKTPSYFVTQEAPRRIFNMSRDTKLIVVVRNPVTRAISDYTQTLSKKPDIPTFEGLSFRNRTLGLVDVSWNAIRIGMYVLHLESWLQYFPLAQIHFVSGERLITDPAGEMGRVQDFLGIKRFITDKHFYFNKTKGFPCLKNRIEPPASMLGQIKRENSCTD

SEQ ID NO: 48908 - protein, 406 aa, Homo sapiens
MAPPGPASALSTSAEPLSRSIFRKFLLMLCSLLTSLYVFYCLAERCQTLSGPVVGLSGGGEEAGAPGGGVLAGGPRELAVWPAAAQRKRLLQLPQWRRRRPPAPRDDGEEAAWEEESPGLSGGPGGSGAGSTVAEAPPGTLALLLDEGSKQLPQAIIIGVKKGGTRALLEFLRVHPDVRAVGAEPHFFDRSYDKGLAWYRDLMPRTLDGQITMEKTPSYFVTREAPARISAMSKDTKLIVVVRDPVTRAISDYTQTLSKRPDIPTFESLTFKNRTAGLIDTSWSAIQIGIYAKHLEHWLRHFPIRQMLFVSGERLISDPAGELGRVQDFLGLKRIITDKHFYFNKTKGFPCLKKAEGSSRPHCLGKTKGRTHPEIDREVVRRLREFYRPFNLKFYQMTGHDFGWDG

SEQ ID NO: 48909 - protein, 390 aa, Homo sapiens
MGQRLSGGRSCLDVPGRLLPQPPPPPPPVRRKLALLFAMLCVWLYMFLYSCAGSCAAAPGLLLLGSGSRAAHDPPALATAPDGTPPRLPFRAPPATPLASGKEMAEGAASPEEQSPEVPDSPSPISSFFSGSGSKQLPQAIIIGVKKGGTRALLEFLRVHPDVRAVGAEPHFFDRSYDKGLAWYRDLMPRTLDGQITMEKTPSYFVTREAPARISAMSKDTKLIVVVRDPVTRAISDYTQTLSKRPDIPTFESLTFKNRTAGLIDTSWSAIQIGIYAKHLEHWLRHFPIRQMLFVSGERLISDPAGELGRVQDFLGLKRIITDKHFYFNKTKGFPCLKKAEGSSRPHCLGKTKGRTHPEIDREVVRRLREFYRPFNLKFYQMTGHDFGWD

SEQ ID NO: 48910 - protein, 390 aa, Homo sapiens; identical to SEQ ID NO: 48909

SEQ ID NO: 48911 - protein, 456 aa, Homo sapiens
MARWPAPPPPPPPPPPLAAPPPPGASAKGPPARKLLFMCTLSLSVTYLCYSLLGGSGSLQFPLALQESPGAAAEPPPSPPPPSLLPTPVRLGAPSQPPAPPPLDNASHGEPPEPPEQPAAPGTDGWGLPSGGGGAQDAWLRTPLAPSEMITAQSALPEREAQESSTTDEDLAGRRAANGSSERGGAVSTPDYGEKKLPQALIIGVKKGGTRALLEAIRVHPDVRAVGVEPHFFDRNYEKGLEWYRNVMPKTLDGQITMEKTPSYFVTNEAPKRIHSMAKDIKLIVVVRNPVTRAISDYTQTLSKKPEIPTFEVLAFKNRTLGLIDASWSAIRIGIYALHLENWLQYFPLSQILFVSGERLIVDPAGEMAKVQDFLGLKRVVTEKHFYFNKTKGFPCLKKPEDSSAPRCLGKSKGRTHPRIDPDVIHRLRKFYKPFNLMFYQMTGQDFQWEQEEGDK

SEQ ID NO: 48912 - protein, 346 aa, Homo sapiens
MLFKQQAWLRQKLLVLGSLAVGSLLYLVARVGSLDRLQPICPIEGRLGGARTQAEFPLRALQFKRGLLHEFRKGNASKEQVRLHDLVQQLPKAIIIGVRKGGTRALLEMLNLHPAVVKASQEIHFFDNDENYGKGIEWYRKKMPFSYPQQITIEKSPAYFITEEVPERIYKMNSSIKLLIIVREPTTRAISDYTQVLEGKERKNKTYYKFEKLAIDPNTCEVNTKYKAVRTSIYTKHLERWLKYFPIEQFHVVDGDRLITEPLPELQLVEKFLNLPPRISQYNLYFNATRGFYCLRFNIIFNKCLAGSKGRIHPEVDPSVITKLRKFFHPFNQKFYQITGRTLNWP

SEQ ID NO: 48913 - protein, 346 aa, Homo sapiens; identical to SEQ ID NO: 48912

SEQ ID NO: 48914 - protein, 322 aa, Homo sapiens
MLFIKFIHLEVFSMPERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTAPDTATPSHRHGPICGSKSISSLLVKVSPVCKDSHCHCRRGTGTPKGETLATLAPCSQSWSSVTHRW

SEQ ID NO: 48915 - protein, 303 aa, Homo sapiens
MLFIKFIHLEVFSMPERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTAPDTATPSHRHGPICGSKSISSLLVKVSPVCKDSHCLGKCSRNGLSAV

SEQ ID NO: 48916 - protein, 356 aa, Homo sapiens
MGLLRIMMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTGKKSHLRKTTEKKLPTKQTIAKLQQSDIWKMENEFYEFALEQFQFIRAHAVREKDGDLYILAQNFFYEKIYPKSN

SEQ ID NO: 48917 - protein, 229 aa, Homo sapiens
MGLLRIMMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECW

SEQ ID NO: 48918 - protein, 411 aa, Homo sapiens
MRRRRAGGRTMVERASKFVLVVAGSVCFMLILYQYAGPGLSLGAPGGRAPPDDLDLFPTPDPHYEKKYYFPVRELERSLRFDMKGDDVIVFLHIQKTGGTTFGRHLVQNVRLEVPCDCRPGQKKCTCYRPNRRETWLFSRFSTGWSCGLHADWTELTNCVPGVLDRRDSAALRTPRKFYYITLLRDPVSRYLSEWRHVQRGATWKTSLHMCDGRTPTPEELPPCYEGTDWSGCTLQEFMDCPYNLANNRQVRMLADLSLVGCYNLSFIPEGKRAQLLLESAKKNLRGMAFFGLTEFQRKTQYLFERTFNLKFIRPFMQYNSTRAGGVEVDEDTIRRIEELNDLDMQLYDYAKDLFQQRYQYKRQLERREQRLRSREERLLHRAKEALPREDADEPGRVPTEDYMSHIIEKW

SEQ ID NO: 48919 - protein, 276 aa, Homo sapiens
MLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRWRIFQILDAASKDKRGSPNTNAGANSPSSTKTRNTSKSGKNFHYITILRDPVSRYLSEWRHVQRGATWKASLHVCDGRPPTSEELPSCYTGDDWSGCPLKEFMDCPYNLANNRCACSPT

SEQ ID NO: 48920 - protein, 462 aa, Homo sapiens
MDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRWRIFQILDAASKDKRGSPNTNAGANSPSSTKTRNTSKSGKNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSKEQNDNTSNGTNDYIGSVEKWR

SEQ ID NO: 48921 - protein, 605 aa, Homo sapiens
MALPACAVREFEPPRQPERGAPVRTTCPRRHSRVEAELAASRPGSVAASVRAGPPRGVSHGFHTRPLLDKPRKASSSLAGAACAPLFALLSRGRRRRMHVLRRRWDLGSLCRALLTRGLAALGHSLKHVLGAIFSKIFGPMASVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 48922 - protein, 459 aa, Homo sapiens
MDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 48923 - protein, 331 aa, Homo sapiens
MLLKHNGKLLLFYLLSYQALASDWFYCSFNRWRIFQILDAARNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 48924 - protein, 645 aa, Homo sapiens
MALPACAVREFEPPRQPERGAPVRTTCPRRHSRVEAELAASRPGSVAASVRAGPPRGVSHGFHTRPLLDKPRKASSSLAGAACAPLFALLSRGRRRRMHVLRRRWDLGSLCRALLTRGLAALGHSLKHVLGAIFSKIFGPMASVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRWRIFQILDAASKDKRGSPNTNAGANSPSSTKTRNTSKSGKNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 48925 - protein, 471 aa, Homo sapiens
MDERFNKWLLTPVLTLLFVVIMYQYVSPSCTSSCTNFGEQPRAGEAGPPAVPGPARRAQAPPEEWERRPQLPPPPRGPPEGPRGAAAPEEEDEEPGDPREGEEEEEEDEPDPEAPENGSLPRFVPRFNFSLKDLTRFVDFNIKGRDVIVFLHIQKTGGTTFGRHLVKNIRLEQPCSCKAGQKKCTCHRPGKKETWLFSRFSTGWSCGLHADWTELTNCVPAIMEKKDCPRNHSHTRNFYYITMLRDPVSRYLSEWKHVQRGATWKTSLHMCDGRSPTPDELPTCYPGDDWSGVSLREFMDCTYNLANNRQVRMLADLSLVGCYNLTFMNESERNTILLQSAKNNLKNMAFFGLTEFQRKTQFLFERTFNLKFISPFTQFNITRASNVEINEGARQRIEDLNFLDMQLYEYAKDLFQQRYHHTKQLEHQRDRQKRREERRLQREHRDHQWPKEDGAAEGTVTEDYNSQVVRW

SEQ ID NO: 48926 - protein, 180 aa, Homo sapiens
  MOD_RES (1)..(1): Any amino acid
XAQTPPPPPAAVAVAVTPVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDR

SEQ ID NO: 48927 - protein, 94 aa, Homo sapiens
  MOD_RES (1)..(1): Any amino acid
XGHPHSPSSGAAWAAAFLGGRPPGTSCCTLSVQPLRTQAATAAGSPTRWAQPRPLPSCSSKNPELGPELPRDVYMPGPWTLGEGPGQCPAGYPR

SEQ ID NO: 48928 - protein, 4391 aa, Homo sapiens
MGWRAAGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLMGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCNCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLAASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 48929 - protein, 239 aa, Homo sapiens
VTHGLRAYDGLSLPEDIETVTASQMRWTHSYLSDDEDMLADSISGDDLGSGDLGSGDFQMGSWMAGFLWSWMWARKGMRMGLRFRRCCSGSSPAALWPPTSPLPRDSSSDAWAQCPSSQEPARRPSLPATATMSVWPWSIAVTGGPTAGTCLMSSIVRSQSWVSAPHSLSLWRRHLYRPGQRQPSCDSHQSPTLLSPCFPVPSGPCPVGPRRPHAAMGTASPETTSATDRRTARTAAMS

SEQ ID NO: 48930 - protein, 188 aa, Homo sapiens
MNAGASVLTFPWAVYGLPRARPAVTDLTGPLPPSSPALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDA

SEQ ID NO: 48931 - protein, 197 aa, Homo sapiens
  MOD_RES (1)..(1): Any amino acid
XTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKVSPNPCPCGACSAPLPRPCGEIRQHLVEAETWAWGAGHGGQGRGCP

SEQ ID NO: 48932 - protein, 163 aa, Homo sapiens
PPVKIESSSPSVTEGQTLDLNCVVAGSAHAQVTWYRRGGSLPPHTQVHGSRLRLPQVSPADSGEYVCRVENGSGPKEASITVSYCPPAWSWCVPGSTRPIRIEPSSSHVAEGQTLDLNCVVPGQAHAQVTWHKRGGSLPARHQTHGSLLRLHQVTPADSGEYV

SEQ ID NO: 48933 - protein, 190 aa, Homo sapiens
PEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTGEPILVSGIASSRLVGSPFSVSAIGSQLGLAHH

SEQ ID NO: 48934 - protein, 207 aa, Homo sapiens
GESREGRGYRQVAQRVAERSPVPSLLSHSGCVVHTRLSPVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYV

SEQ ID NO: 48935 - protein, 367 aa, Homo sapiens
MGWRRGRGAPRFPDGMAAGQRRSSLSRLGSQAEGLLTSQTMGGQAETLLTSQTGWLLGRGCNLGSPGGQVSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 48936 - protein, 222 aa, Homo sapiens
MSGAGRALAALLLAASVLSAALLAPGGSSGRDAQAAPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLRVLLCHPGWSAVAPSRLTPSSASRVHTILLPQPPE

SEQ ID NO: 48937 - protein, 635 aa, Homo sapiens
MSGAGRALAALLLAASVLSAALLAPGGSSGRDAQAAPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLSLDDFNNWISKAISSRETDRLINSELGSPSRTDPLDGDVQPATWRLSALPPRLRSVDTFRGIALILMVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 48938 - protein, 663 aa, Homo sapiens
MTGARASAAEQRRAGRSGQARAAERAAGMSGAGRALAALLLAASVLSAALLAPGGSSGRDAQAAPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLSLDDFNNWISKAISSRETDRLINSELGSPSRTDPLDGDVQPATWRLSALPPRLRSVDTFRGIALILMVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 48939 - protein, 548 aa, Homo sapiens
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKTQRCQYCGII

SEQ ID NO: 48940 - protein, 534 aa, Homo sapiens
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 48941 - protein, 592 aa, Homo sapiens
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 48942 - protein, 480 aa, Homo sapiens
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 48943 - protein, 416 aa, Homo sapiens
MKRERGALSRASRALRLAPFVYLLLIQTDPLEGVNITSPVRLIHGTVGKSALLSVQYSSTSSDRPVVKWQLKRDKPVTVVQSIGTEVIGTLRPDYRDRIRLFENGSLLLSDLQLADEGTYEVEISITDDTFTGEKTINLTVDVPISRPQVLVASTTVLELSEAFTLNCSHENGTKPSYTWLKDGKPLLNDSRMLLSPDQKVLTITRVLMEDDDLYSCMVENPISQGRSLPVKITVYRRSSLYIILSTGGIFLLVTLVTVCACWKPSKRKQKKLEKQNSLEYMDQNDDRLKPEADTLPRSGEQERKNPMALYILKDKDSPETEENPAPEPRSATEPGPPGYSVSPAVPGRSPGLPIRSARRYPRSPARSPATGRTHSSPPRAPSSPGRSRSASRTLRTAGVHIIREQDEAGPVEISA

SEQ ID NO: 48944 - protein, 367 aa, Homo sapiens
MKRERGALSRASRALRLAPFVYLLLIQTDPLEGVNITSPVRLIHGTVGKSALLSVQYSSTSSDRPVVKWQLKRDKPVTVVQSIGTEVIGTLRPDYRDRIRLFENGSLLLSDLQLADEGTYEVEISITDDTFTGEKTINLTVDVPISRPQVLVASTTVLELSEAFTLNCSHENGTKPSYTWLKDGKPLLNDSRMLLSPDQKVLTITRVLMEDDDLYSCMVENPISQGRSLPVKITVYRRSSLYIILSTGGIFLLVTLVTVCACWKPSKRKQKKLEKQNSLEYMDQNDDRLKPEGELPATQSPIPSTIRSVGCWEKAELGDKENSSAGTLPSDLGASKGKEPEPASLASSHSLPRRHAMPSTLSVSVHE

SEQ ID NO: 48945 - protein, 295 aa, Homo sapiens
MEKMSRPLPLNPTFIPPPYGVLRSLLENPLKLPLHHEDAFSKDKDKEKKLDDESNSPTVPQSAFLGPTLWDKTLPYDGDTFQLEYMDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 48946 - protein, 210 aa, Homo sapiens
MDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 48947 - protein, 364 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 48948 - protein, 401 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKMFHLAAFKLKLCKMQLKRKSKQKTISTLRIVFMPRTKTQWCSLRVYAHECRRLNRHQHIRRLLDPKTIFLFQFHLAFQHVSDTG

SEQ ID NO: 48949 - protein, 223 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHE

SEQ ID NO: 48950 - protein, 364 aa, Homo sapiens; identical to SEQ ID NO: 48947

SEQ ID NO: 48951 - protein, 364 aa, Homo sapiens; identical to SEQ ID NO: 48947

SEQ ID NO: 48952 - protein, 173 aa, Homo sapiens
MEPGAGHLDGHRAGSPSLRQALCDGSAVMFSSKERGRCTVINFVPLEAPLRSTPRSRQVTEACGGEGRAVPLGSEPEWSVGGMEATLEQHLEDTMKNPSIVGVLCTDSQGLNLGCRGTLSDEHAGVISVLAQQAAKLTSDPTDIPVVCLESDNGNIMIQKHDGITVAVHKMAS

SEQ ID NO: 48953 - protein, 88 aa, Homo sapiens
MGNWGLGIAPWVDGESELEFRRLGMQGPLEALRRREWNTQRASFSFSFLIALSPHTVDYCHSYELFNRRWHGHVLATQRPSLFILMLV

SEQ ID NO: 48954 - protein, 777 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQLQAMPAAGGVLYQPSGPASFPSTFSPAGSVEGSPMHGVYMSQPAPAAGPYPSMPSTAADPSMVSAYMYPAGATGAQAAPQAQAGPTASPAYSSYQPTPTAGYQNVASQAPQSLPAISQPPQSSTMGYMGSQSVSMGYQPYNMQNLMTTLPSQDASLPPQQPYIAGQQPMYQQMAPSGGPPQQQPPVAQQPQAQGPPAQGSEAQLISFD

SEQ ID NO: 48955 - protein, 691 aa, Homo sapiens
MGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMMHGVYMSQPAPAAGPYPSMPSTAADPSMVSAYMYPAGATGAQAAPQAQAGPTASPAYSSYQPTPTAGYQNVASQAPQSLPAISQPPQSSTMGYMGSQSVSMGYQPYNMQNLMTTLPSQDASLPPQQPYIAGQQPMYQQMAPSGGPPQQQPPVAQQPQAQGPPAQGSEAQLISFD

SEQ ID NO: 48956 - protein, 107 aa, Homo sapiens
MRLSKTLVDMDMADYSAALDPAYTTLEFENVQVLTMGNDFVAAASRQIEASPPTSLEHIWRGGQFSTGRHVPIRRHQPQRAQQPGCQRPVCHLRGPGHGQTLRCLEL

SEQ ID NO: 48957 - protein, 474 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 48958 - protein, 452 aa, Homo sapiens
MVSVNAPLGAPVESSYDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 48959 - protein, 504 aa, Homo sapiens
MRLSKTLVDMDMADYSAALDPAYTTLEFENVQVLTMGNVLLPLRLARLRHPLRHHWSISGGVDSSPQGDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 48960 - protein, 464 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMSTPETPQPSPPGGSGSEPYKLLPGAVATIVKPLSAIPQPTITKQEVI

SEQ ID NO: 48961 - protein, 417 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGPCQAQEGRGWSGDSPGDRPHTVSSPLSSLASPLCRFGQVA

SEQ ID NO: 48962 - protein, 442 aa, Homo sapiens
MVSVNAPLGAPVESSYDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMSTPETPQPSPPGGSGSEPYKLLPGAVATIVKPLSAIPQPTITKQEVI

SEQ ID NO: 48963 - protein, 408 aa, Homo sapiens
MNTTDNGVNCLCAICGDRATGKHYGASSCDGCKGFFRRSIRKSHVYSCRFSRQCVVDKDKRNQCRYCRLRKCFRAGMKKEAVQNERDRISTRRSTFDGSNIPSINTLAQAEVRSRQISVSSPGSSTDINVKKIASIGDVCESMKQQLLVLVEWAKYIPAFCELPLDDQVALLRAHAGEHLLLGATKRSMMYKDILLLGNNYVIHRNSCEVEISRVANRVLDELVRPFQEIQIDDNEYACLKAIVFFDPDAKGLSDPVKIKNMRFQVQIGLEDYINDRQYDSRGRFGELLLLLPTLQSITWQMIEQIQFVKLFGMVKIDNLLQEMLLGGASNDGSHLHHPMHPHLSQDPLTGQTILLGPMSTLVHADQISTPETPLPSPPQGSGQEQYKIAANQASVISHQHLSKQKQL

SEQ ID NO: 48964 - protein, 445 aa, Homo sapiens
MDMANYSEVLDPTYTTLEFETMQILYNSSDSSAPETSMNTTDNGVNCLCAICGDRATGKHYGASSCDGCKGFFRRSIRKSHVYSCRFSRQCVVDKDKRNQCRYCRLRKCFRAGMKKEAVQNERDRISTRRSTFDGSNIPSINTLAQAEVRSRQISVSSPGSSTDINVKKIASIGDVCESMKQQLLVLVEWAKYIPAFCELPLDDQVALLRAHAGEHLLLGATKRSMMYKDILLLGNNYVIHRNSCEVEISRVANRVLDELVRPFQEIQIDDNEYACLKAIVFFDPDAKGLSDPVKIKNMRFQVQIGLEDYINDRQYDSRGRFGELLLLLPTLQSITWQMIEQIQFVKLFGMVKIDNLLQEMLLGGASNDGSHLHHPMHPHLSQDPLTGQTILLGPMSTLVHADQISTPETPLPSPPQGSGQEQYKIAANQASVISHQHLSKQKQL

SEQ ID NO: 48965 - protein, 240 aa, Homo sapiens
MSRSNRQKEYKCGDLVFAKMKGYPHWPARIDEMPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 48966 - protein, 256 aa, Homo sapiens
MHPEGGQFVPQLLGHLLATKLKRFLLSKGGRRAQIPDVSRATPHTIDEMPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 48967 - protein, 233 aa, Homo sapiens
MEQRAGGNRVQTSTLNCAGAAVIDEMPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 48968 - protein, 262 aa, Homo sapiens [sequence omitted]

SEQ ID NO: 48969 - protein, 208 aa, Homo sapiens
MPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 48970 - protein, 240 aa, Homo sapiens; identical to SEQ ID NO: 48965

SEQ ID NO: 48971 - protein, 891 aa, Homo sapiens
MHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 48972 - protein, 1158 aa, Homo sapiens
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 48973 - protein, 1161 aa, Homo sapiens
MWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 48974 - protein, 969 aa, Homo sapiens
MWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 48975 - protein, 811 aa, Homo sapiens
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDDPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEP

SEQ ID NO: 48976 - protein, 1160 aa, Homo sapiens
MWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKVPPRDIEEGNVKMLGMQIPIKNVEMLASVLVAISVTLLLVVLALGGVVWYQHRQRKLRRNRRSILDDSFKLLSFKQ

SEQ ID NO: 48977 - protein, 208 aa, Homo sapiens
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKR

SEQ ID NO: 48978 - protein, 1212 aa, Homo sapiens
MTQTLPYHLSLLNVLFPGPCSRHFKFRRGKCAQPAWRKVSAPSQDLLITKVMWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 48979 - protein, 417 aa, Homo sapiens
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 48980 - protein, 417 aa, Homo sapiens; identical to SEQ ID NO: 48979

SEQ ID NO: 48981 - protein, 393 aa, Homo sapiens
MCKMRTREDMQLGNEGPGTALRLIHLQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKVKVGSRWEPGWGRLGV

SEQ ID NO: 48982 - protein, 700 aa, Homo sapiens [sequence omitted]

SEQ ID NO: 48983 - protein, 324 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQPSPRRARSSQNIPVQQAWSPHSTGPTGGSSAETETDSFSLPEEYFTPAPSPGDQSSGEDRRKAGGNNS

SEQ ID NO: 48984 - protein, 326 aa, Homo sapiens
RLIHPQLCELCIEALERHVIQAVNTSPERGGEEALHAFLLVHSKLLAFYSSHSASSLRPADLLALILLVQDLYPSESTAEDDIQETDSFSLPEEYFTPAPSPGDQSSGSTIWLEGGTPPMDALQIAEDTLQTLVPHCPVPSGPRRIFLDANVKESYCPLVPHTMYCLPLWQGINLVLLTRSPSAPLALVLSQLMDGFSMLEKKLKEGPEPGASLRSQPLVGDLRQRMDKFVKNRGAQEIQSTWLEFKAKAFSKSEPGSSWELLQACGKLKRQLCAIYRLNFLTTAPSRGGPHLPQHLQDQVQRLMREKLTDWKDFLLVKSRRNITM

SEQ ID NO: 48985 - protein, 700 aa, Homo sapiens [sequence omitted]

SEQ ID NO: 48986 - protein, 667 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQETDSFSLPEEYFTPAPSPGDQSSGSTIWLEGGTPPMDALQIAEDTLQTLVPHCPVPSGPRRIFLDANVKESYCPLVPHTMYCLPLWQGINLVLLTRSPSAPLALVLSQLMDGFSMLEKKLKEGPEPGASLRSQPLVGDLRQRMDKFVKNRGAQEIQSTWLEFKAKAFSKSEPGSSWELLQACGKLKRQLCAIYRLNFLTTAPSRGGPHLPQHLQDQVQRLMREKLTDWKDFLLVKSRRNITMVSYLEDFPGLVHFIYVDRTTGQMVAPSLNCSQKTSSELGKGPLAAFVKTKVWSLIQLARRYLQKGYTTLLFQEGDFYCSYFLWFENDMGYKLQMIEVPVLSDDSVPIGMLGGDYYRKLLRYYSKNRPTEAVRCYELLALHLSVIPTDLLVQQAGQLARRLWEASRIPLL

SEQ ID NO: 48987 - protein, 159 aa, Homo sapiens
  MOD_RES (1)..(1): Any amino acid
XLRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQETDSFSLPEEYFTPAPSPGDQSSGEDRRKAGGNNS

SEQ ID NO: 48988 - protein, 1004 aa, Homo sapiens
MVQLYNLHPFGSQQVVPCKLEPDRFCGGGRDALFVAAGCKVEAFAVAGQELCQPRCAFSTLGRVLRLAYSEAGDYLVAIEEKNKATFLRAYVNWRNKRTENSRVCIRMIGHNVEGPFSKAFRDQMYIIEMPLSEAPLCISCCPVKGDLLVGCTNKLVLFSLKYQIINEEFSLLDFERSLIIHIDNITPVEVSFCVGYVAVMSDLEVLIVKLESGPKNGERVHHHPHKTNNRIRRTEEGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLLSRKDTSVKIKIPPVAEAGWNLYIVNTISPVQLYKEMVDYSNTYKTVKTQSCIHLLSEAHLLVRAALMDASQLEPGEKAELLEAFKESCGHLGDCYSRLDSQHSHLTLPYYKMSGLSMAEVLARTDWTVEDGLQKYERGLIFYINHSLYENLDEELNEELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQSLICGPSFDIASIIPFLEPLSEDTIAGLSVHVLCRTRLKEYEQCIDILLERCPEAVIPYANHELKEENRTLWWKKLLPELCQRIKCGGEKYQLYLSSLKETLSIVAVELELKDFMNVLPEDGTATFFLPYLLYCSRKKPLT

SEQ ID NO: 48989 - protein, 528 aa, Homo sapiens
MATSTSTEAKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGKWMLWSFKNRVTHQNPNGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPKSTVLFSGGCVKGSDTQLCVPGLVWYLEPQFYYVIVRHFFDSMRQTAG

SEQ ID NO: 48990 - protein, 708 aa, Homo sapiens
MATSTSTEAKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLVLSLLAEEPLLGDSAAIEEVYHSSLASLNGLEVHLKETLPRDEAASTSSTYNFTHYDRIQSLLMANLPQVATPQDRRFLQAVSLMHSEFAQLPALYEMTVRNASTAVYACCNPIQETYFQQLAPAARSSGFPNPQDGAFSLSGKAKQKLLKHGVNLL

SEQ ID NO: 48991 - protein, 721 aa, Homo sapiens
MAPLCSLARWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGKWMLWSFKNRVTHQNPNGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLVLSLLAEEPLLGDSAAIEEVYHSSLASLNGLEVHLKETLPRDEAASTSSTYNFTHYDRIQSLLMANLPQVATPQDRRFLQAVSLMHSEFAQLPALYEMTVRNASTAVYACCNPIQETYFQQLAPAARSSGFPNPQDGAFSLSGKAKQKLLKHGVNLL

SEQ ID NO: 48992 - protein, 708 aa, Homo sapiens; identical to SEQ ID NO: 48990

SEQ ID NO: 48993 - protein, 703 aa, Homo sapiens
MAPLCSLARWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLVLSLLAEEPLLGDSAAIEEVYHSSLASLNGLEVHLKETLPRDEAASTSSTYNFTHYDRIQSLLMANLPQVATPQDRRFLQAVSLMHSEFAQLPALYEMTVRNASTAVYACCNPIQETYFQQLAPAARSSGFPNPQDGAFSLSGKAKQKLLKHGVNLL

SEQ ID NO: 48994 - protein, 1129 aa, Homo sapiens
MAFVPVIPESYSHVLAEFESLDPLLSALRLDSSRLKCTSIAVSRKWLALGSSGGGLHLIQKEGWKHRLFLSHREGAISQVACCLHDDDYVAVATSQGLVVVWELNQERRGKPEQMYVSSEHKGRRVTALCWDTAILRVFVGDHAGKVSAIKLNTSKQAKAAAAFVMFPVQTITTVDSCVVQLDYLDGRLLISSLTRSFLCDTEREKFWKIGNKERDGEYGACFFPGRCSGGQQPLIYCARPGSRMWEVNFDGEVISTHQFKKLLSLPPLPVITLRSEPQYDHTAGSSQSLSFPKLLHLSEHCVLTWTERGIYIFIPQNVQVLLWSEVKDIQDVAVCRNELFCLHLNGKVSHLSLISVERCVERLLRRGLWNLAARTCCLFQNSVIASRARKTLTADKLEHLKSQLDHGTYNDLISQLEELILKFEPLDSACSSRRSSISSHESFSILDSGIYRIISSRRGSQSDEDSCSLHSQTLSEDERFKEFTSQQEEDLPDQCCGSHGNEDNVSHAPVMFETDKNETFLPFGIPLPFRSPSPLVSLQAVKESVSSFVRKTTEKIGTLHTSPDLKVRPELRGDEQSCEEDVSSDTCPKEEDTEEEKEVTSPPPEEDRFQELKVATAEAMTKLQDPLVLFESESLRMVLQEWLSHLEKTFAMKDFSGVSDTDNSSMKLNQDVLLVNESKKGILDEDNEKEKRDSLGNEESVDKTACECVRSPRESLDDLFQICSPCAIASGLRNDLAELTTLCLELNVLNSKIKSTSGHVDHTLQQYSPEILACQFLKKYFFLLNLKRAKESIKLSYSNSPSVWDTFIEGLKEMASSNPVYMEMEKGDLPTRLKLLDDEVPFDSPLLVVYATRLYEKFGESALRSLIKFFPSILPSDIIQLCHHHPAEFLAYLDSLVKSRPEDQRSSFLESLLQPESLRLDWLLLAVSLDAPPSTSTMDDEGYPRPHSHLLSWGYSQLILHLIKLPADFITKEKMTDICRSCGFWPGYLILCLELERRREAFTNIVYLNDMSLMEGDNGWIPETVEEWKLLLHLIQSKSTRPAPQESLNGSLSDGPSPINVENVALLLAKAMGPDRAWSLLQECGLALELSEKFTRTCDILRIAEKRQRALIQSMLEKCDRFLWSQQA

SEQ ID NO: 48995 - protein, 1015 aa, Homo sapiens
MYVSSEHKGRRVTALCWDTAILRVFVGDHAGKVSAIKLNTSKQAKAAAAFVMFPVQTITTVDSCVVQLDYLDGRLLISSLTRSFLCDTEREKFWKIGNKERDGEYGACFFPGRCSGGQQPLIYCARPGSRMWEVNFDGEVISTHQFKKLLSLPPLPVITLRSEPQYDHTAGSSQSLSFPKLLHLSEHCVLTWTERGIYIFIPQNVQVLLWSEVKDIQDVAVCRNELFCLHLNGKVSHLSLISVERCVERLLRRGLWNLAARTCCLFQNSVIASRARKTLTADKLEHLKSQLDHGTYNDLISQLEELILKFEPLDSACSSRRSSISSHESFSILDSGIYRIISSRRGSQSDEDSCSLHSQTLSEDERFKEFTSQQEEDLPDQCCGSHGNEDNVSHAPVMFETDKNETFLPFGIPLPFRSPSPLVSLQAVKESVSSFVRKTTEKIGTLHTSPDLKVRPELRGDEQSCEEDVSSDTCPKEEDTEEEKEVTSPPPEEDRFQELKVATAEAMTKLQDPLVLFESESLRMVLQEWLSHLEKTFAMKDFSGVSDTDNSSMKLNQDVLLVNESKKGILDEDNEKEKRDSLGNEESVDKTACECVRSPRESLDDLFQICSPCAIASGLRNDLAELTTLCLELNVLNSKIKSTSGHVDHTLQQYSPEILACQFLKKYFFLLNLKRAKESIKLSYSNSPSVWDTFIEGLKEMASSNPVYMEMEKGDLPTRLKLLDDEVPFDSPLLVVYATRLYEKFGESALRSLIKFFPSILPSDIIQLCHHHPAEFLAYLDSLVKSRPEDQRSSFLESLLQPESLRLDWLLLAVSLDAPPSTSTMDDEGYPRPHSHLLSWGYSQLILHLIKLPADFITKEKMTDICRSCGFWPGYLILCLELERRREAFTNIVYLNDMSLMEGDNGWIPETVEEWKLLLHLIQSKSTRPAPQESLNGSLSDGPSPINVENVALLLAKAMGPDRAWSLLQECGLALELSEKFTRTCDILRIAEKRQRALIQSMLEKCDRFLWSQQA

SEQ ID NO: 48996 - protein, 1015 aa, Homo sapiens; identical to SEQ ID NO: 48995

SEQ ID NO: 48997 - protein, 775 aa, Homo sapiens
MKRSGTLRLLSDLSAFGGAARLRELVAGDSAVRVRGSPDGRHLLLLRPPGAVAPQLLVASRGPGAELERAWPAGQPSPLDAFFLPWPARPALVLVWESGLAEVWGAGVGPGWRPLQSTELCPGGGARVVAVAALRGRLVWCEERQARAEGPSGSPAAAFSHCVCVRTLEPSGEASTSLGRTHVLLHHCPAFGLLASCRQLFLVPTATTWPGVAHVLLIWSPGKGKVMVAAPRLGLSYSKSLNPGRGDTWDFRTLLRGLPGLLSPREPLAVHTWAPTPQGLLLLDFGGTVSLLQSHGGTRAVGTLQEAPVGPWGSAALGTFQGTLACVLGSTLELLDMGSGQLLERKVLSTDRVHLLEPPAPGMEDEEELETRGNLRLLSALGLFCVGWEAPQGVELPSAKDLVFEEACGYYQRRSLRGAQLTPEELRHSSTFRAPQALASILQGHLPPSALLTMLRTELRDYRGLEQLKAQLVAGDDEEAGWTELAEQEVARLLRTELIGDQLAQLNTVFQALPTAAWGATLRALQLQLDGNGKLRSQAPPDVWKKVLGGITAGKEPPNGILPPFELLCQCLCQLEPRWLPPFVELAQQQGGPGWGAGGPGLPLYRRALAVLGEEGTRPEALELELLLSSGRPKAVLQAVGQLVQKEQWDRALDAGLALGPSSPLLRSEIFKLLLAEFAQHRRLDAHLPLLCRLCPPELAPAELLLLLRTYLPDEVGPPTPFPEPGAEPPLTVGLLKALLEQTGAQGWLSGPVLSPYEDILWDPSTPPPTPPRDL

SEQ ID NO: 48998 - protein, 531 aa, Homo sapiens
MLGFLSRGPSMKLCMGLACVLSLWNTVSGIKGEAKKEKGMTFLPTTVSGLREEERKEKGVAFLATTELPARSIDLSALNLTELVNGMLSRALKDSKKFFSLLSVTSYSSFAFHKFSVAVYNISNLKTVDPAKFPTRYCYCLNNRTNDLSDFTALLVDIIGNSTSYLTEIFKSTSILSVNQSNESDCIFICVMTGKSGRNLSDFWEIEEKYPIINYTFTSGLSGVLGAATRGTARTSKPTTKSQKTLPSTSPGHWTQSTPWASALRSSPWTETAAPSETEETLNTGRPPELPARATATWFSASHTLPALATRRVARTQWLTADRQTWASISSVPWAQTISEKKPGGSLWETRSSPPTTAGTEEAMNTTSLLAPAAEIMATPGSPSQASPTLGAFTHGTQTPSPTKATAPRYPQTGDLSAEWPFTAGEEPVLVPRPHQVSRCPQPLFKVGAMAAAPLTLAIQRLNPCLMELCQFFQQCLCMSQRSPRTEDMRYCLEYYSWFLKNATYICQRVKRVSHSHTLKQKCLENICKSV

SEQ ID NO: 48999 - protein, 185 aa, Homo sapiens
MSPSLQEGAQLGENKPSTCSFSIERILGLDQKKDCVPLMKPHRPWADTCSSSGKDGNLCLHVPNPPSGISFPSVVDHPMPEERASKYENYFSASERLSLKRELSWYRGRRPRTAFTQNQIEVLENVFRVNCYPGIDIREDLAQKLNLEEDRIQIWFQNRRAKLKRSHRESQFLMAKKNFNTNLLE

SEQ ID NO: 49000 - protein, 107 aa, Homo sapiens
MSPSLQEGAQLGENKPSTCSFSIERILGLDQKKDCVPLMKPHRPWADTCSSSGKDGNLCLHVPNPPSGISFPSVVDHPMPEERASKYENYFSASERLSLKRELSWYR

SEQ ID NO: 49001 - protein, 420 aa, Homo sapiens
MEVPPRLSHVPPPLFPSAPATLASRSLSHWRPRPPRQLAPLLPSLAPSSARQGARRAQRHVTAQQPSRLAGGAAIKGGRRRRPDLFRRHFKSSSIQRSAAAAAATRTARQHPPADSSVTMEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPY

SEQ ID NO: 49002 - protein, 244 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQQSTYGKASRGGGNHQNNYQPY

SEQ ID NO: 49003 - protein, 420 aa, Homo sapiens; identical to SEQ ID NO: 49001

SEQ ID NO: 49004 - protein, 633 aa, Homo sapiens
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 49005 - protein, 633 aa, Homo sapiens; identical to SEQ ID NO: 49004

SEQ ID NO: 49006 - protein, 636 aa, Homo sapiens
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTGLTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 49007 - protein, 473 aa, Homo sapiens
MKTYRQREKQGSKVQESTKGPDEAKIKALLERTGYTLDVTTGQRKYGGPPPDSVYSGVQPGIGTECDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 49008 - protein, 595 aa, Homo sapiens
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 49009 - protein, 767 aa, Homo sapiens
MRSWAFSYLDAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 49010 - protein, 122 aa, Homo sapiens
MDVRRLKVNELREELQRRGLDTRGLKAELAERLQAALEAEEPDDERELDADDEPGRPGHINEEAELQPATLQPGRLQPGLHSPTASTSTTTCLQLWELRRLQPGPLYPTATPHCTDLPSAQL

SEQ ID NO: 49011 - protein, 756 aa, Homo sapiens
MDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 49012 - protein, 752 aa, Homo sapiens
MDVRRLKVNELREELQRRGLDTRGLKAELAERLQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKDFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQSFGFFPSTFQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 49013 - protein, 856 aa, Homo sapiens
MDVRRLKVNELREELQRRGLDTRGLKAELAERLQAALEAEEPDDERELDADDEPGRPGHINEEVETEGGSELEGTAQPPPPGLQPHAEPGGYSGPDGHYAMDNITRQNQFYDTQVIKQENESGYERRPLEMEQQQAYRPEMKTEMKQGAPTSFLPPEASQLKPDRQQFQSRKRPYEENRGRGYFEHREDRRGRSPQPPAEEDEDDFDDTLVAIDTYNCDLHFKVARDRSSGYPLTIEGFAYLWSGARASYGVRRGRVCFEMKINEEISVKHLPSTEPDPHVVRIGWSLDSCSTQLGEEPFSYGYGGTGKKSTNSRFENYGDKFAENDVIGCFADFECGNDVELSFTKNGKWMGIAFRIQKEALGGQALYPHVLVKNCAVEFNFGQRAEPYCSVLPGFTFIQHLPLSERIRGTVGPKSKAECEILMMVGLPAAGKTTWAIKHAASNPSKKYNILGTNAIMDKMRVMGLRRQRNYAGRWDVLIQQATQCLNRLIQIAARKKRNYILDQTNVYGSAQRRKMRPFEGFQRKAIVICPTDEDLKDRTIKRTDEEGKDVPDHAVLEMKANFTLPDVGDFLDEVLFIELQREEADKLVRQYNEEGRKAGPPPEKRFDNRGGGGFRGRGGGGGFQRYENRGPPGGNRGGFQNRGGGSGGGGNYRGGFNRSGGGGYSQNRWGNNNRDNNNSNNRGSYNRAPQQQPPPQQPPPPQPPPQQPPPPPSYSPARNPPGASTYNKNSNIPGSSANTSTPTVSSYSPPQPSYSQPPYNQGGYSQGYTAPPPPPPPPPAYNYGSYGGYNPAPYTPPPPPTAQTYPQPSYNQYQQYAQQWNQYYQNQGQWPPYYGNYDYGSYSGNTQGGTSTQ

SEQ ID NO: 49014 - protein, 916 aa, Homo sapiens
MDCEHSLSLPCRGAEAWEIGIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 49015 - protein, 917 aa, Homo sapiens
MIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 49016 - protein, 905 aa, Homo sapiens
MAKRALHDFIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 49017 - protein, 921 aa, Homo sapiens
MGQICQRESATAAEKPKLHLLAESEIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 49018 - protein, 915 aa, Homo sapiens
MIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEA

SEQ ID NO: 49019 - protein, 114 aa, Homo sapiens
MAKRALHDFIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQL

SEQ ID NO: 49020 - protein, 291 aa, Homo sapiens
MDCEHSLSLPCRGAEAWEIGIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQL

SEQ ID NO: 49021 - protein, 952 aa, Homo sapiens
MGQICQRESRQGLAMLPRLFLNPWRQVILLPQPPKVLGLQATAAEKPKLHLLAESEIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 49022 - protein, 139 aa, Homo sapiens
MGQICQRESATAAEKPKLHLLAESEIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLG

SEQ ID NO: 49023 - protein, 917 aa, Homo sapiens
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 49024 - protein, 889 aa, Homo sapiens
MRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 49025 - protein, 917 aa, Homo sapiens; identical to SEQ ID NO: 49023

SEQ ID NO: 49026 - protein, 923 aa, Homo sapiens
MDSIGSSGLRQGEETLSCSEEGLPGPSDSSELVQECLQQFKVTRAQLQQIQASLLGSMEQALRGQASPAPAVRMLPTYVGSTPHGTEQGDFVVLELGATGASLRVLWVTLTGIEGHRVEPRSQEFVIPQEVMLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSFSDDGALGPVLTTFDHTLDHESLNPGAQRFEKMIGGLYLGELVRLVLAHLARCGVLFGGCTSPALLSQGSILLEHVAEMEDPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRENRGLEELAVSVGVDGTLYKLHPRFSSLVAATVRELAPRCVVTFLQSEDGSGKGAALVTAVACRLAQLTRV

SEQ ID NO: 49027 - protein, 529 aa, Homo sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYIVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 49028 - protein, 301 aa, Homo sapiens
MMTSVYSSLRLSGELSEDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYIVEPLAFEGTPEQKALVIGGEACMWGEYVDNTNLVPRLW

SEQ ID NO: 49029 - protein, 168 aa, Homo sapiens
MAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTYP

SEQ ID NO: 49030 - protein, 556 aa, Homo sapiens
MELCGLGLPRPPMLLALLLATLLAAMLALLTQVALVVQVAEAARAPSVSAKPGPALWPLPLLVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 49031 - protein, 331 aa, Homo sapiens
MAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 49032 - protein, 791 aa, Homo sapiens
MWNMLIVAMCLALLGCLQAQELQGHVSIILLGATGDLAKKYLWQGLFQLYLDEAGRGHSFSFHGAALTAPKQGQELMAKALESLSCPKDMAPSHCAEHKDQFLQLSQYRQLKTAEDYQALNKDIEAQLQHAGLREAGRIFYFSVPPFAYEDIARNINSSCRPGPGAWLRVVLEKPFGHDHFSAQQLATELGTFFQEEEMYRVDHYLGKQAVAQILPFRDQNRKALDGLWNRHHVERVEIIMKETVDAEGRTSFYEEYGVIRDVLQNHLTEVLTLVAMELPHNVSSAEAVLRHKLQVFQALRGLQRGSAVVGQYQSYSEQVRRELQKPDSFHSLTPTFAAVLVHIDNLRWEGVPFILMSGKALDERVGYARILFKNQACCVQSEKHWAAAQSQCLPRQLVFHIGHGDLGSPAVLVSRNLFRPSLPSSWKEMEGPPGLRLFGSPLSDYYAYSPVRERDAHSVLLSHIFHGRKNFFITTENLLASWNFWTPLLESLAHKAPRLYPGGAENGRLLDFEFSSGRLFFSQQQPEQLVPGPGPAPMPSDFQVLRAKYRESPLVSAWSEELISKLANDIEATAVRAVRRFGQFHLALSGGSSPVALFQQLATAHYGFPWAHTHLWLVDERCVPLSDPESNFQGLQAHLLQHVRIPYYNIHPMPVHLQQRLCAEEDQGAQIYAREISALVANSSFDLVLLGMGADGHTASLFPQSPTGLDGEQLVVLTTSPSQPHRRMSLSLPLINRAKKVAVLVMGRMKREITTLVSRVGHEPKKWPISGVLPHSGQLVWYMDYDAFLG

SEQ ID NO: 49033 - protein, 655 aa, Homo sapiens
MGRWAWVPSPWPPPGLGPFLLLLLLLLLLPRGFQPQPGGNRTESPEPNATATPAIPTILVTSVTSETPATSAPEAEGPQSGGLPPPPRAVPSSSSPQAQALTEDGRPCRFPFRYGGRMLHACTSEGSAHRKWCATTHNYDRDRAWGYCVEATPPPGGPAALDPCASGPCLNGGSCSNTQDPQSYHCSCPRAFTGKDCGTEKCFDETRYEYLEGGDRWARVRQGHVEQCECFGGRTWCEGTRHTACLSSPCLNGGTCHLIVATGTTVCACPPGFAGRLCNIEPDERCFLGNGTGYRGVASTSASGLSCLAWNSDLLYQELHVDSVGAAALLGLGPHAYCRNPDNDERPWCYVVKDSALSWEYCRLEACESLTRVQLSPDLLATLPEPASPGRQACGRRHKKRTFLRPRIIGGSSSLPGSHPWLAAIYIGDSFCAGSLVHTCWVVSAAHCFSHSPPRDSVSVVLGQHFFNRTTDVTQTFGIEKYIPYTLYSVFNPSDHDLVLIRLKKKGDRCATRSQFVQPICLPEPGSTFPAGHKCQIAGWGHLDENVSGYSSSLREALVPLVADHKCSSPEVYGADISPNMLCAGYFDCKSDACQGDSGGPLACEKNGVAYLYGIISWGDGCGRLHKPGVYTRVANYVDWINDRIRPPRRLVAPS

SEQ ID NO: 49034 - protein, 1268 aa, Homo sapiens [sequence omitted]

SEQ ID NO: 49035 - protein, 1268 aa, Homo sapiens [sequence omitted]

SEQ ID NO: 49036 - protein, 1268 aa, Homo sapiens [sequence omitted]

SEQ ID NO: 49037 - protein, 82 aa, Homo sapiens
MSSVAVLTQESFAEHRSGLVPQQIKVATLNSEEESDPPTYKDAFPPLPEKAACLESAQEPSGAWGNKIRPIKASVITQVFHV

SEQ ID NO: 49038 - protein, 14 aa, Homo sapiens
MSSVAVLTQESFAE

SEQ ID NO: 49039 - protein, 69 aa, Homo sapiens
MSSVAVLTQESFAEHRSGLVPQQIKVATLNSEEESDPPTYKDAFPPLPEKAACLESAQEPSGAWGNKIR

SEQ ID NO: 49040 - protein, 54 aa, Homo sapiens
MSSVAVLTQESFAEHRSGLVPQQIKVATLNSEEESDPPTYKDAFPPLPEKAACL

SEQ ID NO: 49041 - protein, 224 aa, Homo sapiens
MSSVAVLTQESFAEHRSGLVPQQIKVATLNSEEESDPPTYKDAFPPLPEKAACLESAQEPSGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAV

SEQ ID NO: 49042 - protein, 81 aa, Homo sapiens
MSSVAVLTQESFAEHRSGLVPQQIKVATLNSEEESDPPTYKDAFPPLPEKAACLESAQEPSGAWGNKIRPIKASVITQVFH

SEQ ID NO: 49043 - protein, 79 aa, Homo sapiens
MSSVAVLTQESFAEHRSGLVPQQIKVATLNSEEESDPPTYKDAFPPLPEKAACLESAQEPSGAWGNKIRPIKASVITQV

SEQ ID NO: 49044 - protein, 96 aa, Homo sapiens
MSSVAVLTQESFAEHRSGLVPQQIKVATLNSEEESDPPTYKDAFPPLPEKAACLESAQEPSGAWGNKIRPIKASVITQVFHVPLEERKYKDMNQFG

SEQ ID NO: 49045 - protein, 19 aa, Homo sapiens
MSSVAVLTQESFAEHRSGL

SEQ ID NO: 49046 - protein, 1235 aa, Homo sapiens
MHLAERDRWLFVATVMMHFVSIKSGFPGLCVGVRSTMSSVAVLTQESFAEHRSGLVPQQIKVATLNSEEESDPPTYKDAFPPLPEKAACLESAQEPSGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKANSFTVSSVAAPSWLHRFIIGKKGQNLAKITQQMPKVHIEFTEGEDKITLEGPTEDVNVAQEQIEGMVKDLINRMDYVEINIDHKFHRHLIGKSGANINRIKDQYKVSVRIPPDSEKSNLIRIEGDPQGVQQAKRELLELASRMENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQIKFPDREENAVHSTEPVVQENGDEAGEGREAKDCDPGSPRRCDIIIISGRKEKCEAAKEALEALVPVTIEVEVPFDLHRYVIGQKGSGIRKMMDEFEVNIHVPAPELQSDIIAITGLAANLDRAKAGLLERVKELQAEQEDRALRSFKLSVTVDPKYHPKIIGRKGAVITQIRLEHDVNIQFPDKDDGNQPQDQITITGYEKNTEAARDAILRIVGELEQMVSEDVPLDHRVHARIIGARGKAIRKIMDEFKVDIRFPQSGAPDPNCVTVTGLPENVEEAIDHILNLEEEYLADVVDSEALQVYMKPPAHEEAKAPSRGFVVRDAPWTASSSEKAPDMSSSEEFPSFGAQVAPKTLPWGPKR

SEQ ID NO: 49047 - protein, 221 aa, Homo sapiens
MSSVAVLTQESFAEHRSGLVPQQIKVATLNSEEESDPPTYKDAFPPLPEKAACLESAQEPSGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDK

SEQ ID NO: 49048 - protein, 141 aa, Homo sapiens
MSSVAVLTQESFAEHRSGLVPQQIKVATLNSEEESDPPTYKDAFPPLPEKAACLESAQEPSGAWGNKIRPIKASVITQVFHVPLEERKYKDMNQFGEGEQAKICLEIMQRTGAHLELSLAKDQGLSIMVSGKLDAVMKARK

SEQ ID NO: 49049 - protein, 126 aa, Homo sapiens
MSSVAVLTQESFAEHRSGLVPQQIKVATLNSEEESDPPTYKDAFPPLPEKAACLESAQEPSGAWGNKIRPIKASVITQVFHVPLEERKYKDMNQFGEGEQAKICLEIMQRTGAHLELSLAKDQGLS

SEQ ID NO: 49050 - protein, 147 aa, Homo sapiens
MSSVAVLTQESFAEHRSGLVPQQIKVATLNSEEESDPPTYKDAFPPLPEKAACLESAQEPSGAWGNKIRPIKASVITQVFHVPLEERKYKDMNQFGEGEQAKICLEIMQRTGAHLELSLAKDQGLSIMVSGKLDAVMKARKDIVARL

SEQ ID NO: 49051 - protein, 17 aa, Homo sapiens
MSSVAVLTQESFAEHRS

SEQ ID NO: 49052 - protein, 164 aa, Homo sapiens
MSSVAVLTQESFAEHRSGLVPQQIKVATLNSEEESDPPTYKDAFPPLPEKAACLESAQEPSGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRF

SEQ ID NO: 49053 - protein, 47 aa, Homo sapiens
MSSVAVLTQESFAEHRSGLVPQQIKVATLNSEEESDPPTYKDAFPPL

SEQ ID NO: 49054 - protein, 347 aa, Homo sapiens
MENLMTSSTLPPLFADEDGSKESNDLATTGLNHPEVPYSSGATSSTNNPEFVEDLSQGQLLQSESSNAAEGNEQRHEDEQRSKRGGWSKGRKRKKPLRDSNAPKSPLTGYVRFMNERREQLRAKRPEVPFPEITRMLGNEWSKLPPEEKQRYLDEADRDKERYMKELEQYQKTEAYKVFSRKTQDRQKGKSHRQDAARQATHDHEKETEVKERSVFDIPIFTEEFLNHSKAREAELRQLRKSNMEFEERNAALQKHVESMRTAVEKLEVDVIQERSRNTVLQQHLETLRQVLTSSFASMPLPGSGETPTVDTIDSYMNRLHSIILANPQDNENFIATVREVVNRLDR

SEQ ID NO: 49055 - protein, 347 aa, Homo sapiens; identical to SEQ ID NO: 49054

SEQ ID NO: 49056 - protein, 156 aa, Homo sapiens
MENLMTSSTLPPLFADEDGSKESNDLATTGLNHPEVPYSSGATSSTNNPEFVEDLSQGQLLQSESSNAAEGNEQRHEDEQRSKRGGWSKGRKRKKPLRDSNAPKSPLTGYVRFMNERREQLRAKRPEVPFPEITRMLGNEWSKLPPEEKQRYLDEA

SEQ ID NO: 49057 - protein, 100 aa, Homo sapiens
MENLMTSSTLPPLFADEDGSKESNDLATTGLNHPEVPYSSGATSSTNNPEFVEDLSQGQLLQSESSNAAEGNEQRHEDEQRSKRGGWSKGRKRKKPLRDS

SEQ ID NO: 49058 - protein, 162 aa, Homo sapiens
MENLMTSSTLPPLFADEDGSKESNDLATTGLNHPEVPYSSGATSSTNNPEFVEDLSQGQLLQSESSNAAEGNEQRHEDEQRSKRGGWSKGRKRKKPLRDSNAPKSPLTGYVRFMNERREQLRAKRPEVPFPEITRMLGNEWSKLPPEEKQRYLDEADRDKER

SEQ ID NO: 49059 - protein, 317 aa, Homo sapiens
MSHGPKQPGAAAAPAGGKAPGQHGGFVVTVKQERGEGPRAGEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEEQNAVLQRHTQSMSSARERLEQELALEERRTLALQQQLQAVRQALTASFASLPVPGTGETPTLGTLDFYMARLHGAIERDPAQHEKLIVRIKEILAQVASEHL

SEQ ID NO: 49060 - protein, 268 aa, Homo sapiens
MDTRVGTAMASPPSMFPSSLKSSWTKTKRVRRSFGAEDECGLRGAERGTAEAHAEHEQRARASGAGAGAGGAEDAGAAAAAPGRAPGAHRQLRLTAGAGHGRNAHAGHSGLLHGPASRSHRARPRPAREAHRPHQGNPGPGRQRAPVRSGRAHDAEEKLWARPCHTPPRGREAGGPPGPGPILHLGGSSPPKIKFLQHPFSFQSPQPPEPGKSTRDTPRRTSQPRVPLLGGQTRYTGSPGHPQDTGQTKPTPSTRQDPPNYSLRGAVP

SEQ ID NO: 49061 - protein, 215 aa, Homo sapiens
MSHGPKQPGAAAAPAGGKAPGQHGGFVVTVKQERGEGPRAGEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEE

SEQ ID NO: 49062 - protein, 142 aa, Homo sapiens
MSHGPKQPGAAAAPAGGKAPGQHGGFVVTVKQERGEGPRAGEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEA

SEQ ID NO: 49063 - protein, 107 aa, Homo sapiens
MSESSSKSSQPLASKQEKDGTEKRGRGRPRKQPPVSPGTALVGSQKEPSEVPTPKRPRGRPKGSKNKGAAKTRKTTTTPGRKPRGRPKKLEKEEEEGISQESSEEEQ

SEQ ID NO: 49064 - protein, 96 aa, Homo sapiens
MSESSSKSSQPLASKQEKDGTEKRGRGRPRKQPPKEPSEVPTPKRPRGRPKGSKNKGAAKTRKTTTTPGRKPRGRPKKLEKEEEEGISQESSEEEQ

SEQ ID NO: 49065 - protein, 96 aa, Homo sapiens; identical to SEQ ID NO: 49064

SEQ ID NO: 49066 - protein, 107 aa, Homo sapiens; identical to SEQ ID NO: 49063

SEQ ID NO: 49067 - protein, 96 aa, Homo sapiens; identical to SEQ ID NO: 49064

SEQ ID NO: 49068 - protein, 328 aa, Homo sapiens
MSESSSKSSQPLASKQEKDGTEKRGRGRPRKQPPVSPGTALVGSQKEPSEVPTPKRPRGRPKGSKNKGEGGRGGHLAGVLGGGAVTHACRLLLTGGAASFWDWTALLRSHRPHPFPRPTITTASGRHPHLPPVPSPPHYTAHQPLQGSHGLSGEQFSPGLSSQLPPPTHAYTHALLDKANIPLSRTLHLLRPHSLGGGDIALWAFGLGAPSLLLHCSLWLPIVGPGRVPLALKGAQAPSHPGTPYSTALAAAGVANGGGCWPPGFPQPNCLCHHVGLTFHPSPTSLVPVLGWTAPFGYRKAGGVSPLLPLHCGHSPLALRLGSEYILW

SEQ ID NO: 49069 - protein, 96 aa, Homo sapiens; identical to SEQ ID NO: 49064

SEQ ID NO: 49070 - protein, 107 aa, Homo sapiens; identical to SEQ ID NO: 49063

SEQ ID NO: 49071 - protein, 106 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWDNLLPRTSSKKKTSLGNSTKRSH

SEQ ID NO: 49072 - protein, 118 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWPQQVVQKKPAQVNVALPGKDHPGNLIYLLFSKNAT

SEQ ID NO: 49073 - protein, 90 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWEEFYIAA

SEQ ID NO: 49074 - protein, 109 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWPQQVVQKKPAQEETEETSSQESAEED

SEQ ID NO: 49075 - protein, 92 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWWLLMKSPCW

SEQ ID NO: 49076 - protein, 103 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWLRAQALDSDGLGSNSGPSLS

SEQ ID NO: 49077 - protein, 86 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWLQN

SEQ ID NO: 49078 - protein, 99 aa, Homo sapiens
MSARGEGAGQPSTSAQGQPAAPAPQKRGRGRPRKQQQEPTGEPSPKRPRGRPKGSKNKSPSKAAQKKAEATGEKRPRGRPRKWPQQVVQKKPAQVRHSH

SEQ ID NO: 49079 - protein, 158 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKF

SEQ ID NO: 49080 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 49081 - protein, 215 aa, Homo sapiens; identical to SEQ ID NO: 49080

SEQ ID NO: 49082 - protein, 97 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKR

SEQ ID NO: 49083 - protein, 158 aa, Homo sapiens; identical to SEQ ID NO: 49079

SEQ ID NO: 49084 - protein, 215 aa, Homo sapiens; identical to SEQ ID NO: 49080

SEQ ID NO: 49085 - protein, 215 aa, Homo sapiens; identical to SEQ ID NO: 49080

SEQ ID NO: 49086 - protein, 162 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKILLHIELKESLMQQKR

SEQ ID NO: 49087 - protein, 209 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKSEAGKKGPGRPTGSKKKNEPEDEEEEEEEEDEDEEEEDEDEE

SEQ ID NO: 49088 - protein, 209 aa, Homo sapiens; identical to SEQ ID NO: 49087

SEQ ID NO: 49089 - protein, 209 aa, Homo sapiens; identical to SEQ ID NO: 49087

SEQ ID NO: 49090 - protein, 134 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWS

SEQ ID NO: 49091 - protein, 200 aa, Homo sapiens
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 49092 - protein, 188 aa, Homo sapiens
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEE

SEQ ID NO: 49093 - protein, 153 aa, Homo sapiens
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKY

SEQ ID NO: 49094 - protein, 200 aa, Homo sapiens; identical to SEQ ID NO: 49091

SEQ ID NO: 49095 - protein, 193 aa, Homo sapiens
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEE

SEQ ID NO: 49096 - protein, 90 aa, Homo sapiens
MPKRKAEGDAKGDKAKVKDEPQRRSARLSAKPAPPKPEPKPKKAPAKKGEKVPKGKKGKADAGKEGNNPAENGDAKTDQAQKAEGAGDAK

SEQ ID NO: 49097 - protein, 77 aa, Homo sapiens
MPKRKSPENTEGKDGSKVTKQEPTRRSARLSAKPAPPKPEPKPRKTSAKKEPGAKISRGAKGKKEEKQEAGKEGTEN

SEQ ID NO: 49098 - protein, 99 aa, Homo sapiens
MPKRKSPENTEGKDGSKVTKQEPTRRSARLSAKPAPPKPEPKPRKTSAKKEPGAKISRGAKGKKEEKQEAGKEGTAPSENGETKAEEAQKTESVDNEGE

SEQ ID NO: 49099 - protein, 168 aa, Homo sapiens
MVLFFRINLQTKKCKQKGKGEQRENRPKWLTKKLKKTYLRKTGKRRLRRVQPLMKQERKKPSLINNHIPCLISGPCLPSCTIQRNIFINYFVNASFLVALETFLRRRESHLIPFFKCKCFFLRGEIICWLFIFWYNQKIVWDIELWEALTVSGVSLTFHRWGVSFYIL

SEQ ID NO: 49100 - protein, 100 aa, Homo sapiens
MPKRKVSSAEGAAKEEPKRRSARLSAKPPAKVEAKPKKAAAKDKSSDKKVQTKGKRGAKGKQAEVANQETKEDLPAENGETKTEESPASDEAGEKEAKSD

SEQ ID NO: 49101 - protein, 193 aa, Homo sapiens
MGKQNSKLRPEMLQDLRENTEFSELELQEWYKGFLKDCPTGILNVDEFKKIYANFFPYGDASKFAEHVFRTFDTNSDGTIDFREFIIALSVTSRGRLEQKLMWAFSMYDLDGNGYISREEMLEIVQAIYKMVSSVMKMPEDESTPEKRTEKIFRQMDTNNDGKLSLEEFIRGAKSDPSIVRLLQCDPSSASQF

SEQ ID NO: 49102 - protein, 193 aa, Homo sapiens
MGKQNSKLRPEVLQDLRENTEFTDHELQEWYKGFLKDCPTGHLTVDEFKKIYANFFPYGDASKFAEHVFRTFDTNGDGTIDFREFIIALSVTSRGKLEQKLKWAFSMYDLDGNGYISRSEMLEIVQAIYKMVSSVMKMPEDESTPEKRTDKIFRQMDTNNDGKLSLEEFIRGAKSDPSIVRLLQCDPSSASQF

SEQ ID NO: 49103 - protein, 193 aa, Homo sapiens; identical to SEQ ID NO: 49102

SEQ ID NO: 49104 - protein, 30 aa, Homo sapiens
MGKQNSKLRPEVLQDLRENTEFTDHELQEW

SEQ ID NO: 49105 - protein, 1017 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCLSAPALALKLPIPSPQRAFTLQVSSDPSMYIEVENEVTVVGGVKLSRLKCNREGKEWETVLTSRILTAAGSCDVVCVACEKRMLSVFSTCGRRLLSPILLPSPISTLHCTGSYVMALTAAATLSVWDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 49106 - protein, 810 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 49107 - protein, 604 aa, Homo sapiens
MLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCLSAPALALKLPIPSPQRAFTLQVSSDPSMYIEVENEVTVVGGVKLSRLKCNREGKEWETVLTSRILTAAGSCDVVCVACEKRMLSVFSTCGRRLLSPILLPSPISTLHCTGSYVMALTAAATLSVWDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGSAEEGAAEGAATSHRAEPPIPAPLHRVSGTARHPEGQVACPSLPWLQQGQGHTLAADDMQDRLSPDQAVGGGDTGRRCAVLHQRQPSSLGRCALCPGSDIASGGGSSSLPPSPRCGARAGALPRCPGASKAVPGLPSPARPQGGH

SEQ ID NO: 49108 - protein, 973 aa, Homo sapiens [sequence omitted]

SEQ ID NO: 49109 - protein, 806 aa, Homo sapiens
MSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCLSAPALALKLPIPSPQRAFTLQVSSDPSMYIEVENEVTVVGGVKLSRLKCNREGKEWETVLTSRILTAAGSCDVVCVACEKRMLSVFSTCGRRLLSPILLPSPISTLHCTGSYVMALTAAATLSVWDVHRQVVVVKEESLHSILAGTWFLTSRTHWLSVQTLGAACHPRTPCCAQDR

SEQ ID NO: 49110 - protein, 51 aa, Homo sapiens
MASSMRSLFSDHGKYVESFRRFLNHSTEHQCMQEFMDKKLPGIIGRYQNCC

SEQ ID NO: 49111 - protein, 292 aa, Homo sapiens
MASSMRSLFSDHGKYVESFRRFLNHSTEHQCMQEFMDKKLPGIIGRIGDTKSEIKILSIGGGAGEIDLQILSKVQAQYPGVCINNEVVEPSAEQIAKYKELVAKTSNLENVKFAWHKETSSEYQSRMLEKKELQKWDFIHMIQMLYYVKDIPATLKFFHSLLGTNAKMLIIVVSGSSGWDKLWKKYGSRFPQDDLCQYITSDDLTQMLDNLGLKYECYDLLSTMDISDCFIDGNENGDLLWDFLTETCNFNATAPPDLRAELGKDLQEPEFSAKKEGKVLFNNTLSFIVIEA

SEQ ID NO: 49112 - protein, 126 aa, Homo sapiens
MASSMRSLFSDHGKYVESFRRFLNHSTEHQCMQEFMDKKLPGIIGRIGDTKSEIKILSIGGGADCLIRGSSRVLKRNSCFILCSTRQKDKPGMRIHDERSSELPFGAARLESKSAFPSFLVSFILF

SEQ ID NO: 49113 - protein, 292 aa, Homo sapiens; identical to SEQ ID NO: 49111

SEQ ID NO: 49114 - protein, 487 aa, Homo sapiens
MSLPNSSCLLEDKMCEGNKTTMASPQLMPLVVVLSTICLVTVGLNLLVLYAVRSERKLHTVGNLYIVSLSVADLIVGAVVMPMNILYLLMSKWSLGRPLCLFWLSMDYVASTASIFSVFILCIDRYRSVQQPLRYLKYRTKTRASATILGAWFLSFLWVIPILGWNHFMQQTSVRREDKCETDFYDVTWFKVMTAIINFYLPTLLMLWFYAKIYKAVRQHCQHRELINRSLPSFSEIKLRPENPKGDAKKPGKESPWEVLKRKPKDAGGGSVLKSPSQTPKEMKSPVVFSQEDDREVDKLYCFPLDIVHMQAAAEGSSRDYVAVNRSHGQLKTDEQGLNTHGASEISEDQMLGDSQSFSRTDSDTTTETAPGKGKLRSGSNTGLDYIKFTWKRLRSHSRQYVSGLHMNRERKAAKQLGFIMAAFILCWIPYFIFFMVIAFCKNCCNEHLHMFTIWLGYINSTLNPLIYPLCNENFKKTFKRILHIRS

SEQ ID NO: 49115 - protein, 12 aa, Homo sapiens
MSLPNSSCLLED

SEQ ID NO: 49116 - protein, 487 aa, Homo sapiens; identical to SEQ ID NO: 49114

SEQ ID NO: 49117 - protein, 487 aa, Homo sapiens; identical to SEQ ID NO: 49114

SEQ ID NO: 49118 - protein, 359 aa, Homo sapiens
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDR

SEQ ID NO: 49119 - protein, 397 aa, Homo sapiens
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDRPWLCLPECWSVELTHSFIHLFIHSFANIHPIPTTCQEL

SEQ ID NO: 49120 - protein, 390 aa, Homo sapiens
MPDTNSTINLSLSTRVTLAFFMSLVAFAIMLGNALVILAFVVDKNLRHRSSYFFLNLAISDFFVGVISIPLYIPHTLFEWDFGKEICVFWLTTDYLLCTASVYNIVLISYDRYLSVSNAVSYRTQHTGVLKIVTLMVAVWVLAFLVNGPMILVSESWKDEGSECEPGFFSEWYILAITSFLEFVIPVILVAYFNMNIYWSLWKRDHLSRCQSHPGLTAVSSNICGHSFRGRLSSRRSLSASTEVPASFHSERQRRKSSLMFSSRTKMNSNTIASKMGSFSQSDSVALHQREHVELLRARRLAKSLAILLGVFAVCWAPYSLFTIVLSFYSSATGPKSVWYRIAFWLQWFNSFVNPLLYPLCHKRFQKAFLKIFCIKKQPLPSQHSRSVSS

SEQ ID NO: 49121 - protein, 302 aa, Homo sapiens
MPDTNSTINLSLSTRVTLAFFMSLVAFAIMLGNALVILAFVVDKNLRHRSSYFFLNLAISDFFVVSESWKDEGSECEPGFFSEWYILAITSFLEFVIPVILVAYFNMNIYWSLWKRDHLSRCQSHPGLTAVSSNICGHSFRGRLSSRRSLSASTEVPASFHSERQRRKSSLMFSSRTKMNSNTIASKMGSFSQSDSVALHQREHVELLRARRLAKSLAILLGVFAVCWAPYSLFTIVLSFYSSATGPKSVWYRIAFWLQWFNSFVNPLLYPLCHKRFQKAFLKIFCIKKQPLPSQHSRSVSS

SEQ ID NO: 49122 - protein, 57 aa, Homo sapiens
MKFFVFALVLALMISMISADSHEKRHHGYRRKFHEKHHSHREFPFYGDYGSNYLYDN

SEQ ID NO: 49123 - protein, 57 aa, Homo sapiens; identical to SEQ ID NO: 49122

SEQ ID NO: 49124 - protein, 51 aa, Homo sapiens
MKFFVFALILALMLSMTGADSHAKRHHGYKRKFHEKHHSHRGYRSNYLYDN

SEQ ID NO: 49125 - protein, 51 aa, Homo sapiens; identical to SEQ ID NO: 49124

SEQ ID NO: 49126 - protein, 662 aa, Homo sapiens
MMEPEEYRERGREMVDYICQYLSTVRERRVTPDVQPGYLRAQLPESAPEDPDSWDSIFGDIERIIMPGVVHWQSPHMHAYYPALTSWPSLLGDMLADAINCLGFTWASSPACTELEMNVMDWLAKMLGLPEHFLHHHPSSQGGGVLQSTVSESTLIALLAARKNKILEMKTSEPDADESCLNARLVAYASDQAHSSVEKAGLISLVKMKFLPVDDNFSLRGEALQKAIEEDKQRGLVPVFVCATLGTTGVCAFDCLSELGPICAREGLWLHIDAAYAGTAFLCPEFRGFLKGIEYADSFTFNPSKWMMVHFDCTGFWVKDKYKLQQTFSVNPIYLRHANSGVATDFMHWQIPLSRRFRSVKLWFVIRSFGVKNLQAHVRHGTEMAKYFESLVRNDPSFEIPAKRHLGLVVFRLKGPNCLTENVLKEIAKAGRLFLIPATIQDKLIIRFTVTSQFTTRDDILRDWNLIRDAATLILSQHCTSQPSPRVGNLISQIRGARAWACGTSLQSVSGAGDDPVQARKIIKQPQRVGAGPMKRENGLHLETLLDPVDDCFSEEAPDATKHKLSSFLFSYLSVQTKKKTVRSLSCNSVPVSAQKPLPTEASVKNGGSSRVRIFSRFPEDMMMLKKSAFKKLIKFYSVPSFPECSSQCGLQLPCCPLQAMV

SEQ ID NO: 49127 - protein, 699 aa, Homo sapiens
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 49128 - protein, 389 aa, Homo sapiens
EDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 49129 - protein, 454 aa, Homo sapiens
MGHHRPWLHASVLWAGVASLLLPPAMTQQLRGDGLGFRNRNKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEE

SEQ ID NO: 49130 - protein, 126 aa, Homo sapiens
MADEIAKAQVARPGGDTIFGKIIRKEIPAKIIFEDDRCLAFHDISPQAPTHFLVIPKKHISQISVAEDDDESLLGHLMIVGKKCAADLGLNKGYRMVVNEGSDGGQSVYHVHLHVLGGRQMHWPPG

SEQ ID NO: 49131 - protein, 163 aa, Homo sapiens
MAAAVVLAAGLRAARRAVAATGVRGGQVRGAAGVTDGNEVAKAQQATPGGAAPTIFSRILDKSLPADILYEDQQCLVFRDVAPQAPVHFLVIPKKPIPRISQAEEEDQQLLGHLLLVAKQTAKAEGLGDGYRLVINDGKLGAQSVYHLHIHVLGGRQLQWPPG

SEQ ID NO: 49132 - protein, 182 aa, Homo sapiens
MAEEQVNRSAGLAPDCEASATAETTVSSVGTCEAAGKSPEPKDYDSTCVFCRIAGRQDPGTELLHCENEDLICFKDIKPAATHHYLVVPKKHIGNCRTLRKDQVELVENMVTVGKTILERNNFTDFTNVRMGFHMPPFCSISHLHLHVLAPVDQLGFLSKLVYRVNSYWFITADHLIEKLRT

SEQ ID NO: 49133 - protein, 525 aa, Homo sapiens
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCPRHHFPRHPNVFGFCRADLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPRPFHCRQIGSVYRLPPLRKGEVLPLPEANFPSFPLPHHKHPLKPDNQPFPQSVSESCPGKFKSGFPQVSMFFTHTFPK

SEQ ID NO: 49134 - protein, 435 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 49135 - protein, 395 aa, Homo sapiens
MAERAALEELVKLQGERVRGLKQQKASAELIEEEVAKLLKLKAQLGPDESKQKFVLKTPKDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 49136 - protein, 469 aa, Homo sapiens
MAERAALEELVKLQGERVRGLKQQKASAELIEEEVAKLLKLKAQLGPDESKQKFVLKTPKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 49137 - protein, 314 aa, Homo sapiens
MTRGRYREFYQCDFDIAGNFDPMIPDAECLKIMCEILSSLQIGDFLVKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 49138 - protein, 509 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 49139 - protein, 440 aa, Homo sapiens
MAVREKVFDVIIRCFKRHGAEVIDTPVFELKETLMGKYGEDSKLIYDLKDQGGELLSLRYDLTVPFARYLAMNKLTNIKRYHIAKVYRRDNPAMTRGRYREFYQCDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 49140 - protein, 288 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLE

SEQ ID NO: 49141 - protein, 449 aa, Homo sapiens
MAERAALEELVKLQGERVRGLKQQKASAELIEEEVAKLLKLKAQLGPDESKQKFVLKTPKETLMGKYGEDSKLIYDLKDQGGELLSLRYDLTVPFARYLAMNKLTNIKRYHIAKDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 49142 - protein, 489 aa, Homo sapiens
MAERAALEELVKLQGERVRGLKQQKASAELIEEEVAKLLKLKAQLGPDESKQKFVLKTPKGTRDYSPRQMAVREKVFDVIIRCFKRHGAEVIDTPVFELKETLMGKYGEDSKLIYDLKDQGGELLSLRYDLTVPFARYLAMNKLTNIKRYHIAKDFDIAGNFDPMIPDAECLKIMCEILSSLQIGDFLVKVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEALEEKIRTTETQVLVASAQKKLLEERLKLVSELWDAGIKAELLYKKNPKLLNQLQYCEEAGIPLVAIIGEQELKDGVIKLRSVTSREEVDVRREDLVEEIKRRTGQPLCIC

SEQ ID NO: 49143 - protein, 506 aa, Homo sapiens
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 49144 - protein, 345 aa, Homo sapiens
MTLLEVPFARYLAMNKVKKMKRYHVGKVWRRESPTIVQGRYREFCQCDFDIAGQFDPMIPDAECLKIMCEILSGLQLGDFLIKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 49145 - protein, 392 aa, Homo sapiens
MPLLGLLPRRAWASLLSQLLRPPCASCTGAVRCQSQVAEAVLTSQLKAHQEKPNFIIKTPKDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 49146 - protein, 466 aa, Homo sapiens
MPLLGLLPRRAWASLLSQLLRPPCASCTGAVRCQSQVAEAVLTSQLKAHQEKPNFIIKTPKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 49147 - protein, 334 aa, Homo sapiens
MPLLGLLPRRAWASLLSQLLRPPCASCTGAVRCQSQDFDIAGQFDPMIPDAECLKIMCEILSGLQLGDFLIKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 49148 - protein, 481 aa, Homo sapiens
MPLLGLLPRRAWASLLSQLLRPPCASCTGAVRCQSQGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 49149 - protein, 394 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYESSAEILPHTPRLTHFPTVSGSPASLADSMQQKLAGPRRRRPQNPSAM

SEQ ID NO: 49150 - protein, 377 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 49151 - protein, 335 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 49152 - protein, 426 aa, Homo sapiens
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYESSAEILPHTPRLTHFPTVSGSPASLADSMQQKLAGPRRRRPQNPSAIYEESNPKDPAAVTESKEGTEASASKGLEKKEK

SEQ ID NO: 49153 - protein, 1136 aa, Homo sapiens
MFSRKKRELMKTPSISKKNRAGSPSPQPSGELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 49154 - protein, 1130 aa, Homo sapiens
SYSPYRAGRQGPQQRGRDPGIQLTELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 49155 - protein, 1004 aa, Homo sapiens
MHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRGECPAGPRGGRWLPATHPGPSPETPLSPAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 49156 - protein, 1152 aa, Homo sapiens
MSRGQRVLKGLLGWVCTWTWAWRARLGARGCGLHVLCPRDLPLPPEELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 49157 - protein, 1019 aa, Homo sapiens
MCICGTAHPVLDEGPVRCRAGPRDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 49158 - protein, 948 aa, Homo sapiens
MFSRKKRELMKTPSISKKNRAGSPSPQPSGELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPMRLRGGRMTLGSCRERQPEFV

SEQ ID NO: 49159 - protein, 1163 aa, Homo sapiens
MFSRKKRELMKTPSISKKNRAGSPSPQPSGPHFISGETEAVSRPENPFNELPSDLPKELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 49160 - protein, 139 aa, Homo sapiens
MSISSALAMVFMGAKGNTAAQMSQALCFSKIGGEDGDIHRGFQSLLVAINRTDTEYVLRTANGLFGEKSYDFLTGFTDSCGKFYQATIKQLDFVNDTEKSTTRVNSWVADKTKGENILLFYFDNILNSFIVSSLQNCQI

SEQ ID NO: 49161 - protein, 53 aa, Homo sapiens
MEIFIEVFSHFLLQLTELTLNMCLELPTGSLEKSLMISSQVLQIPVANSTKQR

SEQ ID NO: 49162 - protein, 215 aa, Homo sapiens
MSETVPPAPAASAAPEKPLAGKKAKKPAKAAAASKKKPAGPSVSELIVQAASSSKERGGVSLAALKKALAAAGYDVEKNNSRIKLGIKSLVSKGTLVQTKGTGASGSFKLNKKASSVETKPGASKVATKTKATGASKKLKKATGASKKSVKTPKKAKKPAATRKSSKNPKKPKTVKPKKVAKSPAKAKAVKPKAAKARVTKPKTAKPKKAAPKKK

SEQ ID NO: 49163 - protein, 226 aa, Homo sapiens
MSETAPAETATPAPVEKSPAKKKATKKAAGAGAAKRKATGPPVSELITKAVAASKERNGLSLAALKKALAAGGYDVEKNNSRIKLGLKSLVSKGTLVQTKGTGASGSFKLNKKAASGEAKPKAKKAGAAKAKKPAGATPKKAKKAAGAKKAVKKTPKKAKKPAAAGVKKVAKSPKKAKAAAKPKKATKSPAKPKAVKPKAAKPKAAKPKAAKPKAAKAKKAAAKKK

SEQ ID NO: 49164 - protein, 213 aa, Homo sapiens [sequence omitted]

SEQ ID NO: 49165 - protein, 221 aa, Homo sapiens
MSETAPLAPTIPAPAEKTPVKKKAKKAGATAGKRKASGPPVSELITKAVAASKERSGVSLAALKKALAAAGYDVEKNNSRIKLGLKSLVSKGTLVQTKGTGASGSFKLNKKAASGEGKPKAKKAGAAKPRKPAGAAKKPKKVAGAATPKKSIKKTPKKVKKPATAAGTKKVAKSAKKVKTPQPKKAAKSPAKAKAPKPKAAKPKSGKPKVTKAKKAAPKKK

SEQ ID NO: 49166 - protein, 219 aa, Homo sapiens
MSETAPAAPAAPAPAEKTPVKKKARKSAGAAKRKASGPPVSELITKAVAASKERSGVSLAALKKALAAAGYDVEKNNSRIKLGLKSLVSKGTLVQTKGTGASGSFKLNKKAASGEAKPKAKKAGAAKAKKPAGAAKKPKKATGAATPKKSAKKTPKKAKKPAAAAGAKKAKSPKKAKAAKPKKAPKSPAKAKAVKPKAAKPKTAKPKAAKPKKAAAKKK

SEQ ID NO: 49167 - protein, 207 aa, Homo sapiens
MSETVPAASASAGVAAMEKLPTKKRGRKPAGLISASRKVPNLSVSKLITEALSVSQERVGMSLVALKKALAAAGYDVEKNNSRIKLSLKSLVNKGILVQTRGTGASGSFKLSKKVIPKSTRSKAKKSVSAKTKKLVLSRDSKSPKTAKTNKRAKKPRATTPKTVRSGRKAKGAKGKQQQKSPVKARASKSKLTQHHEVNVRKATSKK

SEQ ID NO: 49168 - protein, 130 aa, Homo sapiens
MSGRGKQGGKARAKAKTRSSRAGLQFPVGRVHRLLRKGNYSERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 49169 - protein, 130 aa, Homo sapiens
MSGRGKQGGKARAKAKSRSSRAGLQFPVGRVHRLLRKGNYAERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 49170 - protein, 130 aa, Homo sapiens; identical to SEQ ID NO: 49169

SEQ ID NO: 49171 - protein, 130 aa, Homo sapiens
MSGRGKQGGKARAKAKTRSSRAGLQFPVGRVHRLLRKGNYSERVGAGAPVYLAAVLEYLTAEILELAGNAARDNKKTRIIPRHLQLAIRNDEELNKLLGKVTIAQGGVLPNIQAVLLPKKTESHHKAKGK

SEQ ID NO: 49172 - protein, 130 aa, Homo sapiens; identical to SEQ ID NO: 49168

SEQ ID NO: 49173 - protein, 130 aa, Homo sapiens
MSGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKAKGK

SEQ ID NO: 49174 - protein, 128 aa, Homo sapiens
MSGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKTK

SEQ ID NO: 49175 - protein, 130 aa, Homo sapiens; identical to SEQ ID NO: 49173

SEQ ID NO: 49176 - protein, 130 aa, Homo sapiens; identical to SEQ ID NO: 49173

SEQ ID NO: 49177 - protein, 130 aa, Homo sapiens; identical to SEQ ID NO: 49173

SEQ ID NO: 49178 - protein, 127 aa, Homo sapiens
MPEVSSKGATISKKGFKKAVVKTQKKEGKKRKRTRKESYSIYIYKVLKQVHPDTGISSKAMSIMNSFVTDIFERIASEASRLAHYSKRSTISSREIQTAVRLLLPGELAKHAVSEGTKAVTKYTSSK

SEQ ID NO: 49179 - protein, 126 aa, Homo sapiens
MPEPSKSAPAPKKGSKKAITKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 49180 - protein, 126 aa, Homo sapiens
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 49181 - protein, 126 aa, Homo sapiens; identical to SEQ ID NO: 49180

SEQ ID NO: 49182 - protein, 126 aa, Homo sapiens
MPEPTKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 49183 - protein, 126 aa, Homo sapiens; identical to SEQ ID NO: 49182

SEQ ID NO: 49184 - protein, 126 aa, Homo sapiens; identical to SEQ ID NO: 49180

SEQ ID NO: 49185 - protein, 126 aa, Homo sapiens; identical to SEQ ID NO: 49180

SEQ ID NO: 49186 - protein, 126 aa, Homo sapiens; identical to SEQ ID NO: 49180

SEQ ID NO: 49187 - protein, 126 aa, Homo sapiens
MPDPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 49188 - protein, 126 aa, Homo sapiens; identical to SEQ ID NO: 49180

SEQ ID NO: 49189 - protein, 126 aa, Homo sapiens
MPELAKSAPAPKKGSKKAVTKAQKKDGKKRKRSRKESYSVYVYKVLKQVHPDTGISSKAMGIMNSFVNDIFERIASEASRLAHYNKRSTITSREIQTAVRLLLPGELAKHAVSEGTKAVTKYTSSK

SEQ ID NO: 49190 - protein, 126 aa, Homo sapiens
MPEPVKSAPVPKKGSKKAINKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 49191 - protein, 126 aa, Homo sapiens
MPEPSKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 49192 - protein, 126 aa, Homo sapiens; identical to SEQ ID NO: 49191

SEQ ID NO: 49193 - protein, 126 aa, Homo sapiens
MPDPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 49194 - protein, 136 aa, Homo sapiens
MARTKQTARKSTGGKAPRKQLATKAARKSAPATGGVKKPHRYRPGTVALREIRRYQKSTELLIRKLPFQRLVREIAQDFKTDLRFQSSAVMALQEACEAYLVGLFEDTNLCAIHAKRVTIMPKDIQLARRIRGERA

SEQ ID NO: 49195 - protein, 136 aa, Homo sapiens; identical to SEQ ID NO: 49194

SEQ ID NO: 49196 - protein, 136 aa, Homo sapiens; identical to SEQ ID NO: 49194

SEQ ID NO: 49197 - protein, 136 aa, Homo sapiens; identical to SEQ ID NO: 49194

SEQ ID NO: 49198 - protein, 136 aa, Homo sapiens; identical to SEQ ID NO: 49194

SEQ ID NO: 49199 - protein, 136 aa, Homo sapiens; identical to SEQ ID NO: 49194

SEQ ID NO: 49200 - protein, 136 aa, Homo sapiens; identical to SEQ ID NO: 49194

SEQ ID NO: 49201 - protein, 136 aa, Homo sapiens; identical to SEQ ID NO: 49194

SEQ ID NO: 49202 - protein, 136 aa, Homo sapiens; identical to SEQ ID NO: 49194

SEQ ID NO: 49203 - protein, 136 aa, Homo sapiens; identical to SEQ ID NO: 49194

SEQ ID NO: 49204 - protein, 136 aa, Homo sapiens; identical to SEQ ID NO: 49194

SEQ ID NO: 49205 - protein, 112 aa, Homo sapiens
MSGRGKGGKGLAKAKTCSSLPGLQFPGRVRHLFRKGNYFEPVGAGAPVYLQYLAAEILELVGSAIRDKTRSIIPRHLQLAIRNDEEVNKQLGNVTIAQGGVLSNIQAVLLPK

SEQ ID NO: 49206 - protein, 103 aa, Homo sapiens [sequence omitted]

SEQ ID NO: 49207 - protein, 103 aa, Homo sapiens [sequence omitted]

SEQ ID NO: 49208 - protein, 103 aa, Homo sapiens [sequence omitted]

SEQ ID NO: 49209 - protein, 103 aa, Homo sapiens [sequence omitted]

SEQ ID NO: 49210 - protein, 103 aa, Homo sapiens [sequence omitted]

SEQ ID NO: 49211 - protein, 103 aa, Homo sapiens [sequence omitted]

SEQ ID NO: 49212 - protein, 98 aa, Homo sapiens
MSVRGKAGKGLGKGGAKCHRKVLSDNIQGITKCTIRRLARHGGVKRILGLIYEETRRVFKVFLENVIWYAVTNTEHAKRKTVTAMAVVYVLKRQGRTL

SEQ ID NO: 49213 - protein, 103 aa, Homo sapiens [sequence omitted]

SEQ ID NO: 49214 - protein, 103 aa, Homo sapiens [sequence omitted]

SEQ ID NO: 49215 - protein, 103 aa, Homo sapiens [sequence omitted]

SEQ ID NO: 49216 - protein, 103 aa, Homo sapiens [sequence omitted]

SEQ ID NO: 49217 - protein, 103 aa, Homo sapiens [sequence omitted]

SEQ ID NO: 49218 - protein, 103 aa, Homo sapiens [sequence omitted]

SEQ ID NO: 49219 - protein, 129 aa, Homo sapiens
MSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHKAKSK

SEQ ID NO: 49220 - protein, 126 aa, Homo sapiens
MPEPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 49221 - protein, 136 aa, Homo sapiens [sequence omitted]

SEQ ID NO: 49222 - protein, 136 aa, Homo sapiens
MARTKQTARKSTGGKAPRKQLATKVARKSAPATGGVKKPHRYRPGTVALREIRRYQKSTELLIRKLPFQRLMREIAQDFKTDLRFQSSAVMALQEACESYLVGLFEDTNLCVIHAKRVTIMPKDIQLARRIRGERA

SEQ ID NO: 49223 - protein, 1123 aa, Homo sapiens
MNSPNESADGMSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEDDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 49224 - protein, 1037 aa, Homo sapiens
MNSPNESDGMSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEDDGEEEEDCIQVKDEEGESGAEEGPDLEEPGAGYKKLFSDAQPLQPLQVYQAPLSLATVPHQALGRTQSSPAAPGGMKSPPDQPVKHLFTTGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 49225 - protein, 1122 aa, Homo sapiens
MNSPNESDGMSGREPSLEILPRTSLHSIPVTVEVKPVLPRAMPSSMGGGGGGSPSPVELRGALVGSVDPTLREQQLQQELLALKQQQQLQKQLLFAEFQKQHDHLTRQHEVQLQKHLKQQQEMLAAKQQQEMLAAKRQQELEQQRQREQQRQEELEKQRLEQQLLILRNKEKSKESAIASTEVKLRLQEFLLSKSKEPTPGGLNHSLPQHPKCWGAHHASLDQSSPPQSGPPGTPPSYKLPLPGPYDSRDDFPLRKTASEPNLKVRSRLKQKVAERRSSPLLRRKDGTVISTFKKRAVEITGAGPGASSVCNSAPGSGPSSPNSSHSTIAENGFTGSVPNIPTEMLPQHRALPLDSSPNQFSLYTSPSLPNISLGLQATVTVTNSHLTASPKLSTQQEAERQALQSLRQGGTLTGKFMSTSSIPGCLLGVALEGDGSPHGHASLLQHVLLLEQARQQSTLIAVPLHGQSPLVTGERVATSMRTVGKLPRHRPLSRTQSSPLPQSPQALQQLVMQQQHQQFLEKQKQQQLQLGKILTKTGELPRQPTTHPEETEEELTEQQEVLLGEGALTMPREGSTESESTQEDLEEEDEEDDGEEEEDCIQVKDEEGESGAEEGPDLEEPGAGYKKLFSDAQPLQPLQVYQAPLSLATVPHQALGRTQSSPAAPGGMKSPPDQPVKHLFTTGVVYDTFMLKHQCMCGNTHVHPEHAGRIQSIWSRLQETGLLSKCERIRGRKATLDEIQTVHSEYHTLLYGTSPLNRQKLDSKKLLGPISQKMYAVLPCGGIGVDSDTVWNEMHSSSAVRMAVGCLLELAFKVAAGELKNGFAIIRPPGHHAEESTAMGFCFFNSVAITAKLLQQKLNVGKVLIVDWDIHHGNGTQQAFYNDPSVLYISLHRYDNGNFFPGSGAPEEVGGGPGVGYNVNVAWTGGVDPPIGDVEYLTAFRTVVMPIAHEFSPDVVLVSAGFDAVEGHLSPLGGYSVTARCFGHLTRQLMTLAGGRVVLALEGGHDLTAICDASEACVSALLSVELQPLDEAVLQQKPNINAVATLEKVIEIQSKHWSCVQKFAAGLGRSLREAQAGETEEAETVSAMALLSVGAEQAQAAAAREHSPRPAEEPMEQEPAL

SEQ ID NO: 49226 - protein, 591 aa, Homo sapiens
MMSSPAQSRSPDLMWNLVPWVLFCGCCRIFPDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 49227 - protein, 923 aa, Homo sapiens
LHKLSSLVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSMSLKFS

SEQ ID NO: 49228 - protein, 1025 aa, Homo sapiens
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSKYWKSVRMVAVPRGCALAGAQLQEETETVSALASLTVDVEQPFAQEDSRTAGEPMEEEPAL

SEQ ID NO: 49229 - protein, 590 aa, Homo sapiens
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 49230 - protein, 577 aa, Homo sapiens
MLQTIYESDSCFSSDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 49231 - protein, 1066 aa, Homo sapiens
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSKYWKSVRMVAVPRGCALAGAQLQEETETVSALASLTVDVEQPFAQEDSRTAGEPMEEEPAL

SEQ ID NO: 49232 - protein, 148 aa, Homo sapiens
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQ

SEQ ID NO: 49233 - protein, 138 aa, Homo sapiens
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRE

SEQ ID NO: 49234 - protein, 588 aa, Homo sapiens
MMSSPAQPDLMWNLVPWVLFCGCCRIFPDGVAGREQLLAQQRMHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 49235 - protein, 546 aa, Homo sapiens
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 49236 - protein, 1011 aa, Homo sapiens
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSMSLKFS

SEQ ID NO: 49237 - protein, 23 aa, Homo sapiens
MHSMISSVDVKSEVPVGLEPISP

SEQ ID NO: 49238 - protein, 1069 aa, Homo sapiens
MHSMISSVDVKSEVPVGLEPISPLDLRTDLRMMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSKYWKSVRMVAVPRGCALAGAQLQEETETVSALASLTVDVEQPFAQEDSRTAGEPMEEEPAL

SEQ ID NO: 49239 - protein, 562 aa, Homo sapiens
MMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 49240 - protein, 513 aa, Homo sapiens
MMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWAAHHTSLDQSSPPLSGTSPSYKYTLPGAQDAKDDFPLRKTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQVIGKDLAPGFVIKVII

SEQ ID NO: 49241 - protein, 659 aa, Homo sapiens
MRVNHTVSTMLPTCMVHRQTMSCSGAGGITAFVAFRDVAVYFTQEEWRLLSPAQRTLHREVMLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 49242 - protein, 640 aa, Homo sapiens
MATGLLRAKKEAFVAFRDVAVYFTQEEWRLLSPAQRTLHREVMLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 49243 - protein, 438 aa, Homo sapiens
MLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 49244 - protein, 598 aa, Homo sapiens
MLETYNHLVSLEIPSSKPKLIAQLERGEAPWREERKCPLDLCPESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 49245 - protein, 729 aa, Homo sapiens
SWLGPGKASLLRSFPHLCTLLPDFRLQDPQRAPAFHLSSETLPFSRKSTQETRKMATGLLRAKKEAFVAFRDVAVYFTQEEWRLLSPAQRTLHREVMLETYNHLVSLEIPSSKPKLIAQLERGEAPWREERKCPLDLCPAESKPEIQLSPSCPLIFSSQQALSQHVWLSHLSQLFSSLWAGNPLHLGKHYPEDQKQQQDPFCFSGKAEWIQEGEDSRLLFGRVSKNGTSKALSSPPEEQQPAQSKEDNTVVDIGSSPERRADLEETDKVLHGLEVSGFGEIKYEEFGPGFIKESNLLSLQKTQTGETPYMYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHGGSLMCAGSVGKALAGSHTSLDTRGHIQERSLIFAESVDGALVGSPTLSDIRGHTQDRNFMCIGNVVQPLARSHTSSDTRGHTQCCGFFSHC

SEQ ID NO: 49246 - protein, 386 aa, Homo sapiens
MYTEWGDSFGSMSVLIKNPRTHSGGKPYVCRECGRGFTWKSNLITHQRTHSGEKPYVCKDCGRGFTWKSNLFTHQRTHSGLKPYVCKECGQSFSLKSNLITHQRAHTGEKPYVCRECGRGFRQHSHLVRHKRTHSGEKPYICRECEQGFSQKSHLIRHLRTHTGEKPYVCTECGRHFSWKSNLKTHQRTHSGVKPYVCLECGQCFSLKSNLNKHQRSHTGEKPFVCTECGRGFTRKSTLSTHQRTHSGEKPFVCAECGRGFNDKSTLISHQRTHSGEKPFMCRECGRRFRQKPNLFRHKRAHSGAFVCRECGQGFCAKLTLIKHQRAHAGGKPHVCRECGQGFSRQSHLIRHQRTHSGEKPYICRKCGRGFSRKSNLIRHQRTHSG

SEQ ID NO: 49247 - protein, 601 aa, Homo sapiens
MAYDDSVKKEDCFDGDHTFEDIGLAAGRSQREKKRSYKDFLREEEEIAAQVRNSSKKKLKDSELYFLGTDTHKKKRKHSSDDYYYGDISSLESSQKKKKKSSPQSTDTAMDLLKAITSPLAAGSKPSKKTGEKSSGSSSHSESKKEHHRKKVSGSSGELPLEDGGSHKSKKMKPLYVNTETLTLREPDGLKMKLILSPKEKGSSSVDEESFQYPSQQATVKKSSKKSARDEQGALLLGHELQSFLKTARKKHKSSSDAHSSPGPEGCGSDASQFAESHSANLDLSGLEPILVESDSSSGGELEAGELVIDDSYREIKKKKKSKKSKKKKDKEKHKEKRHSKSKRSLGLSAVPVGEVTVTSGPPPSIPYAGAAAPPLPLPGLHTDGHSEKKKKKEEKDKERERGEKPKKKNMSAYQVFCKEYRVTIVADHPGIDFGELSKKLAEVWKQLPEKDKLIWKQKAQYLQHKQNKAEATTVKRKASSSEGSMKVKASSVGVLSPQKKSPPTTMLLPASPAKAPETEPIDVAAHLQLLGESLSLIGHRLQETEGMVAVSGSLSVLLDSIICALGPLACLTTQLPELNGCPKQVLSNTLDNIAYIMPGL

SEQ ID NO: 49248 - protein, 492 aa, Homo sapiens
MDLLKAITSPLAAGSKPSKKTGEKSSGSSSHSESKKEHHRKKVSGSSGELPLEDGGSHKSKKMKPLYVNTETLTLREPDGLKMKLILSPKEKGSSSVDEESFQYPSQQATVKKSSKKSARDEQGALLLGHELQSFLKTARKKHKSSSDAHSSPGPEGCGSDASQFAESHSANLDLSGLEPILVESDSSSGGELEAGELVIDDSYREIKKKKKSKKSKKKKDKEKHKEKRHSKSKRSLGLSAVPVGEVTVTSGPPPSIPYAGAAAPPLPLPGLHTDGHSEKKKKKEEKDKERERGEKPKKKNMSAYQVFCKEYRVTIVADHPGIDFGELSKKLAEVWKQLPEKDKLIWKQKAQYLQHKQNKAEATTVKRKASSSEGSMKVKASSVGVLSPQKKSPPTTMLLPASPAKAPETEPIDVAAHLQLLGESLSLIGHRLQETEGMVAVSGSLSVLLDSIICALGPLACLTTQLPELNGCPKQVLSNTLDNIAYIMPGL

SEQ ID NO: 49249 - protein, 631 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 49250 - protein, 572 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHGERPVPHTAGDDDRGWLSMDAGERGAWQALQSACVSGTSVFPYSSNGQSHLLPSNHSVIETFISTQMASSSQ

SEQ ID NO: 49251 - protein, 521 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGKLVGMGGHLGGRLMGQPQNPGAGRATGTHSFIHQHVFIQCLLWTSHCATSVIPGDSSNGQSHLLPSNHSVIETFISTQMASSSQ

SEQ ID NO: 49252 - protein, 523 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 49253 - protein, 603 aa, Homo sapiens [sequence omitted]

SEQ ID NO: 49254 - protein, 278 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQRRNASREGCPHHRHRGWAPTSSRRCVSTTGLPTGAKKKPSGTSWPWTRTAGPPQGQARDLRCPLTAPLACLHLPSPPVRSTVCAMDSLRPVRLQKYPQAAAVP

SEQ ID NO: 49255 - protein, 119 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQVHPCRAGRAD

SEQ ID NO: 49256 - protein, 662 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVRSRPAGPPLACDRAPHPHIPRAQEAALLPQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 49257 - protein, 247 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRCALWTACDQ

SEQ ID NO: 49258 - protein, 452 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 49259 - protein, 403 aa, Homo sapiens
MVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGKLVGMGGHLGGRLMGQPQNPGAGRATGTHSFIHTTCIYPVPTLDQSLCYISDTWVNQTDQNLSNSSREAGTKHNTSILWYLRR

SEQ ID NO: 49260 - protein, 394 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPAACSQPGRVARLFNF

SEQ ID NO: 49261 - protein, 638 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLVIGLASTQAQSVPVINSMGSSLTTLQPVQFSQPLHPSYQQPLMPPVQSHVTQSPFMATMAQLQSPHALYSHKPEVAQYTHTGLLPQTMLITDTTNLSALASLTPTKQEAALLPQVFTSDTEASSESGLHTPASQATTLHVPSQDPASIQHLQPAHRLSASPTVSSSSLVLYQSSDSSNGQSHLLPSNHSVIETFISTQMASSSQ

SEQ ID NO: 49262 - protein, 471 aa, Homo sapiens [sequence omitted]

SEQ ID NO: 49263 - protein, 452 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLGSNLVTEVRVYNWFANRRKEEAFRHKLAMDTYSGPPPGPGPGPALPAHSSPGLPPPALSPSKVHGVRYGQPATSETAEVPSSSGGPLVTVSTPLHQVSPTGLEPSHSLLSTEAKLVSAAGGPLPPVSTLTALHSLEQTSPGLNQQPQNLIMASLPGVMTIGPGEPASLGPTFTNTGASTLPLFGAGVAELTRQQGPSS

SEQ ID NO: 49264 - protein, 356 aa, Homo sapiens
  MOD_RES (1)..(1): Any amino acid
XWLVGFWGGSGCKEFGLCLPAGRQTQPTRWGRRLAWWTRAAWPCGSRAMVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQPQPAEYRSQAGLSSWGPPPPCQHPDSTAQLGADIPRPQPAAPEPHHGLTSWGHDHRAW

SEQ ID NO: 49265 - protein, 748 aa, Homo sapiens
MLGTLRAMEGEDVEDDQLLQKLRASRRRFQRRMQRLIEKYNQPFEDTPVVQMATLTYETPQGLRIWGGRLIKERNEGEIQDSSMKPADRTDGSVQAAAWGPELPSHRTVLGADSKSGEVDATSDQEESVAWALAPAVPQSPLKNELRRKYLTQVDILLQGAEYFECAGNRAGRDVRVTPLPSLASPAVPAPGYCSRISRKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTYCKGARRSQRSSKENFIPCSEPVKGTGALRDCKNVLDVSCRKTGLKLEKAFLEVNRPQIHKLDPSWKERKVTPSKYSSLIYFDSSATYNLDEENRFRTLKWLISPVKIVSRPTIRQGHGENRQREIEIRFDQLHREYCLSPRNQPRRMCLPDSWAMNMYRGGPASPGGLQGLETRRLSLPSSKAKAKSLSEAFENLGKRSLEAGRCLPKSDSSSSLPKTNPTHSATRPQQTSDLHVQGNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTAIEAPSSTCVARAITRDGTRDHQFPAKRPRLSEPQGSGRQGNSLGASDGVDNTVRPGDQGSSSQPNSEERGENTSYRMEEKSDFMLEKLETKSV

SEQ ID NO: 49266 - protein, 694 aa, Homo sapiens
MLGTLRAMEGEDVEDDQLLQKLRASRRRFQRRMQRLIEKYNQPFEDTPVVQMATLTYETPQGLRIWGGRLIKERNEGEIQPAVPQSPLKNELRRKYLTQVDILLQGAEYFECAGNRAGRDVRVTPLPSLASPAVPAPGYCSRISRKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTYCKGARRSQRSSKENFIPCSEPVKGTGALRDCKNVLDVSCRKTGLKLEKAFLEVNRPQIHKLDPSWKERKVTPSKYSSLIYFDSSATYNLDEENRFRTLKWLISPVKIVSRPTIRQGHGENRQREIEIRFDQLHREYCLSPRNQPRRMCLPDSWAMNMYRGGPASPGGLQGLETRRLSLPSSKAKAKSLSEAFENLGKRSLEAGRCLPKSDSSSSLPKTNPTHSATRPQQTSDLHVQGNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTAIEAPSSTCVARAITRDGTRDHQFPAKRPRLSEPQGSGRQGNSLGASDGVDNTVRPGDQGSSSQPNSEERGENTSYRMEEKSDFMLEKLETKSV

SEQ ID NO: 49267 - protein, 663 aa, Homo sapiens
MLGTLRAMEGEDVEDDQLLQKLRASRRRFQRRMQRLIEKYNQPFEDTPVVQMATLTYETPQGLRIWGGRLIKERNEGEIQCAGNRAGRDVRVTPLPSLASPAVPAPGYCSRISRKSPGDPAKPASSPREWDPLHPSSTDMALVPRNDSLSLQETSSSSFLSSQPFEDDDICNVTISDLYAGMLHSMSRLLSTKPSSIISTKTFIMQNWNSRRRHRYKSRMNKTYCKGARRSQRSSKENFIPCSEPVKGTGALRDCKNVLDVSCRKTGLKLEKAFLEVNRPQIHKLDPSWKERKVTPSKYSSLIYFDSSATYNLDEENRFRTLKWLISPVKIVSRPTIRQGHGENRQREIEIRFDQLHREYCLSPRNQPRRMCLPDSWAMNMYRGGPASPGGLQGLETRRLSLPSSKAKAKSLSEAFENLGKRSLEAGRCLPKSDSSSSLPKTNPTHSATRPQQTSDLHVQGNSSGIFRKSVSPSKTLSVPDKEVPGHGRNRYDEIKEEFDKLHQKYCLKSPGQMTVPLCIGVSTDKASMEVRYQTEGFLGKLNPDPHFQGFQKLPSSPLGCRKSLLGSTAIEAPSSTCVARAITRDGTRDHQFPAKRPRLSEPQGSGRQGNSLGASDGVDNTVRPGDQGSSSQPNSEERGENTSYRMEEKSDFMLEKLETKSV

SEQ ID NO: 49268 - protein, 726 aa, Homo sapiens
MEDRLHMDNGLVPQKIVSVHLQDSTLKEVKDQVSNKQAQILEPKPEPSLEIKPEQDGMEHVGRDDPKALGEEPKQRRGSASGSEPAGDSDRGGGPVEHYHLHLSSCHECLELENSTIESVKFASAENIPDLPYDYSSSLESVADETSPEREGRRVNLTGKAPNILLYVGSDSQEALGRFHEVRSVLADCVDIDSYILYHLLEDSALRDPWTDNCLLLVIATRESIPEDLYQKFMAYLSQGGKVLGLSSSFTFGGFQVTSKGALHKTVQNLVFSKADQSEVKLSVLSSGCRYQEGPVRLSPGRLQGHLENEDKDRMIVHVPFGTRGGEAVLCQVHLELPPSSNIVQTPEDFNLLKSSNFRRYEVLREILTTLGLSCDMKQVPALTPLYLLSAAEEIRDPLMQWLGKHVDSEGEIKSGQLSLRFVSSYVSEVEITPSCIPVVTNMEAFSSEHFNLEIYRQNLQTKQLGKVILFAEVTPTTMRLLDGLMFQTPQEMGLIVIAARQTEGKGRGGNVWLSPVGCALSTLLISIPLRSQLGQRIPFVQHLMSVAVVEAVRSIPEYQDINLRVKWPNDIYYSDLMKIGGVLVNSTLMGETFYILIGCGFNVTNSNPTICINDLITEYNKQHKAELKPLRADYLIARVVTVLEKLIKEFQDKGPNSVLPLYYRYWVHSGQQVHLGSAEGPKVSIVGLDDSGFLQVHQEGGEVVTVHPDGNSFDMLRNLILPKRR

SEQ ID NO: 49269 - protein, 726 aa, Homo sapiens; identical to SEQ ID NO: 49268

SEQ ID NO: 49270 - protein, 87 aa, Homo sapiens
MEDRLHMDNGLVPQKIVSVHLQDSTLKEVKDQVSNKQAQILEPKPEPSLEIKPEQDGMEHVGRDDPKALGEEPKQRRGSASGSEPAG

SEQ ID NO: 49271 - protein, 77 aa, Homo sapiens
MEDRLHMDNGLVPQKIVSVHLQDSTLKEVKDQVSNKQAQILEPKPEPSLEIKPEQDGMEHVGRDDPKALGEEPKQRR

SEQ ID NO: 49272 - protein, 92 aa, Homo sapiens
MEDRLHMDNGLVPQKIVSVHLQDSTLKEVKDQVSNKQAQILEPKPEPSLEIKPEQDGMEHVGRDDPKALGEEPKQRRGSASGSEPAGDSDRG

SEQ ID NO: 49273 - protein, 268 aa, Homo sapiens
MGLSPSAPAVAVQASNASASPPSGCPMHEGKMKGCPVNTEPSGPTCEKKTYSVPAHQERAYEYVECPIRGTAAENKENLDPSNLMPPPNQTPAPDQPFALSTVREESSIPRADSEKKWVYPSEQMFWNAMLKKGWKWKDEDISQKDMYNIIRIHNQNNEQAWKEILKWEALHAAECPCGPSLIRFGGKAKEYSPRARIRSWMGYELPFDRHDWIINRCGTEVRYVIDYYDGGEVNKDYQFTILDVRPALDSLSAVWDRMKVAWWRWTS

SEQ ID NO: 49274 - protein, 268 aa, Homo sapiens; identical to SEQ ID NO: 49273

SEQ ID NO: 49275 - protein, 268 aa, Homo sapiens; identical to SEQ ID NO: 49273

SEQ ID NO: 49276 - protein, 335 aa, Homo sapiens
MDNARMNSFLEYPILSSGDSGTCSARAYPSDHRITTFQSCAVSANSCGGDDRFLVGRGVQIGSPHHHHHHHHRHPQPATYQTSGNLGVSYSHSSCGPSYGSQNFSAPYSPYALNQEADVSGGYPQCAPAVYSGNLSSPMVQHHHHHQGYAGGAVGSPQYIHHSYGQEHQSLALATYNNSLSPLHASHQEACRSPASETSSPAQTFDWMKVKRNPPKTGKVGEYGYLGQPNAVRTNFTTKQLTELEKEFHFNKYLTRARRVEIAASLQLNETQVKIWFQNRRMKQKKREKEGLLPISPATPPGNDEKAEESSEKSSSSPCVPSPGSSTSDTLTTSH

SEQ ID NO: 49277 - protein, 137 aa, Homo sapiens
MDNARMNSFLEYPILSSGDSGTCSARAYPSDHRITTFQSCAVSANSCGGDDRFLVGRGVQIGSPHHHHHHHHRHPQPATYQTSGNLGVSYSHSSCGPSYGSQNFSAPYSPYALNQEADPPRSLSLPRIGDIFSSADF

SEQ ID NO: 49278 - protein, 410 aa, Homo sapiens
MSARKGYLLPSPNYPTTMSCSESPAANSFLVDSLISSGRGEAGGGGGGAGGGGGGGYYAHGGVYLPPAADLPYGLQSCGLFPTLGGKRNEAASPGSGGGGGGLGPGAHGYGPSPIDLWLDAPRSCRMEPPDGPPPPPQQQPPPPPQPPQPAPQATSCSFAQNIKEESSYCLYDSADKCPKVSATAAELAPFPRGPPPDGCALGTSSGVPVPGYFRLSQAYGTAKGYGSGGGGAQQLGAGPFPAQPPGRGFDLPPALASGSADAARKERALDSPPPPTLACGSGGGSQGDEEAHASSSAAEELSPAPSESSKASPEKDSLGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 49279 - protein, 202 aa, Homo sapiens
MSCSESPAANSFLVDSLISSGRGEAGGGGGGAGGGGGGGYYAHGGVYLPPAADLPYGLQSCGLFPTLGGKRNEAASPGSGGGGGGLGPGAHGYGPSPIDLWLDAPRSCRRRAATRGWPVPRAAPGARFRSPARASLRLGRCGPEGASPRFAAAPHAGLRQRRGLAGRRGGARVVLGRGGALPGPFREQQSLAGEGFPGQFQR

SEQ ID NO: 49280 - protein, 94 aa, Homo sapiens
MCQGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 49281 - protein, 313 aa, Homo sapiens
MDFDERGPCSSNMYLPSCTYYVSGPDFSSLPSFLPQTPSSRPMTYSYSSNLPQVQPVREVTFREYAIEPATKWHPRGNLAHCYSAEELVHRDCLQAPSAAGVPGDVLAKSSANVYHHPTPAVSSNFYSTVGRNGVLPQAFDQFFETAYGTPENLASSDYPGDKSAEKGPPAATATSAAAAAAATGAPATSSSDSGGGGGCRETAAAAEEKERRRRPESSSSPESSSGHTEDKAGGSSGQRTRKKRCPYTKYQIRELEREFFFSVYINKEKRLQLSRMLNLTDRQVKIWFQNRRMKEKKINRDRLQYYSANPLL

SEQ ID NO: 49282 - protein, 388 aa, Homo sapiens
MTASVLLHPRWIEPTVMFLYDNGGGLVADELNKNMEGAAAAAAAAAAAAAAGAGGGGFPHPAAAAAGGNFSVAAAAAAAAAAAANQCRNLMAHPAPLAPGAASAYSSAPGEAPPSAAAAAAAAAAAAAAAAAASSSGGPGPAGPAGAEAAKQCSPCSAAAQSSSGPAALPYGYFGSGYYPCARMGPHPNAIKSCAQPASAAAAAAFADKYMDTAGPAAEEFSSRAKEFAFYHQGYAAGPYHHHQPMPGYLDMPVVPGLGGPGESRHEPLGLPMESYQPWALPNGWNGQMYCPKEQAQPPHLWKSTLPDVVSHPSDASSYRRGRKKRVPYTKVQLKELEREYATNKFITKDKRRRISATTNLSERQVTIWFQNRRVKEKKVINKLKTTS

SEQ ID NO: 49283 - protein, 376 aa, Homo sapiens
MNYEFEREIGFINSQPSLAECLTSFPPVADTFQSSSIKTSTLSHSTLIPPPFEQTIPSLNPGSHPRHGAGGRPKPSPAGSRGSPVPAGALQPPEYPWMKEKKAAKKTALLPAAAAAATAAATGPACLSHKESLEIADGSGGGSRRLRTAYTNTQLLELEKEFHFNKYLCRPRRVEIAALLDLTERQVKVWFQNRRMKHKRQTQCKENQNSEGKCKSLEDSEKVEEDEEEKTLFEQALSVSGALLEREGYTFQQNALSQQQAPNGHNGDSQSFPVSPLTSNEKNLKHFQHQSPTVPNCLSTMGQNCGAGLNNDSPEALEVPSLQDFSVFSTDSCLQLSDAVSPSLPGSLDSPVDISADSLDFFTDTLTTIDLQHLNY

SEQ ID NO: 49284 - protein, 320 aa, Homo sapiens
MTMSSFLINSNYIEPKFPPFEEYAQHSGSGGADGGPGGGPGYQQPPAPPTQHLPLQQPQLPHAGGGREPTASYYAPRTAREPAYPAAALYPAHGAADTAYPYGYRGGASPGRPPQPEQPPAQAKGPAHGLHASHVLQPQLPPPLQPRAVPPAAPRRCEAAPATPGVPAGGSAPACPLLLADKSPLGLKGKEPVVYPWMKKIHVSAVNPSYNGGEPKRSRTAYTRQQVLELEKEFHFNRYLTRRRRIEIAHTLCLSERQVKIWFQNRRMKWKKDHKLPNTKMRSSNSASASAGPPGKAQTQSPHLHPHPHPSTSTPVPSSI

SEQ ID NO: 49285 - protein, 320 aa, Homo sapiens; identical to SEQ ID NO: 49284

SEQ ID NO: 49286 - protein, 270 aa, Homo sapiens
MSSYFVNSFCGRYPNGPDYQLHNYGDHSSVSEQFRDSASMHSGRYGYGYNGMDLSVGRSGSGHFGSGERARSYAASASAAPAEPRYSQPATSTHSPQPDPLPCSAVAPSPGSDSHHGGKNSLSNSSGASADAGSTHISSREGVGTASGAEEDAPASSEQASAQSEPSPAPPAQPQIYPWMRKLHISHDNIGGPEGKRARTAYTRYQTLELEKEFHFNRYLTRRRRIEIAHALCLSERQIKIWFQNRRMKWKKDNKLKSMSMAAAGGAFRP

SEQ ID NO: 49287 - protein, 233 aa, Homo sapiens
MSSYFVNPTFPGSLPSGQDSFLGQLPLYQAGYDALRPFPASYGASSLPDKTYTSPCFYQQSNSVLACNRASYEYGASCFYSDKDLSGASPSGSGKQRGPGDYLHFSPEQQYKPDSSSGQGKALHDEGADRKYTSPVYPWMQRMNSCAGAVYGSHGRRGRQTYTRYQTLELEKEFHFNRYLTRRRRIEIANALCLTERQIKIWFQNRRMKWKKENKLINSTQPSGEDSEAKAGE

SEQ ID NO: 49288 - protein, 230 aa, Homo sapiens
MSSSYYVNALFSKYTAGASLFQNAEPTSCSFAPNSQRSGYGAGAGAFASTVPGLYNVNSPLYQSPFASGYGLGADAYGNLPCASYDQNIPGLCSDLAKGACDKTDEGALHGAAEANFRIYPWMRSSGPDRKRGRQTYTRYQTLELEKEFHFNRYLTRRRRIEIAHALCLTERQIKIWFQNRRMKWKKEHKDEGPTAAAAPEGAVPSAAATAAADKADEEDDDEEEEDEEE

SEQ ID NO: 49289 - protein, 30 aa, Homo sapiens
MSSSYYVNALFSKYTAGASLFQNAEPTSCS

SEQ ID NO: 49290 - protein, 263 aa, Homo sapiens
HHWGGNYYVDSFLLGADAADELSVGMRRGPWPPRQAATLAEHPDFSPCSFQSKATVFGASWNPVHRAPTLYPVYHHHHHHPYVHPQAPVAAAAPDGRYMRSWLEPTPGALSFAGLPSSRPYGIKPEPLSARRGDCPTLDTHTLSLTDYACGSPPVDREKQPSEGAFSENNAENESGGDKPPIDPNNPAANWLHARSTRKKRCPYTKHQTLELEKEFLFNMYLTRDRRYEVARLLNLTERQVKIWFQNRRMKMKKINKDRAKDE

SEQ ID NO: 49291 - protein, 272 aa, Homo sapiens
MATTGALGNYYVDSFLLGADAADELSVGRYAPGTLGQPPRQAATLAEHPDFSPCSFQSKATVFGASWNPVHAAGANAVPAAVYHHHHHHPYVHPQAPVAAAAPDGRYMRSWLEPTPGALSFAGLPSSRPYGIKPEPLSARRGDCPTLDTHTLSLTDYACGSPPVDREKQPSEGAFSENNAENESGGDKPPIDPNNPAANWLHARSTRKKRCPYTKHQTLELEKEFLFNMYLTRDRRYEVARLLNLTERQVKIWFQNRRMKMKKINKDRAKDE

SEQ ID NO: 49292 - protein, 196 aa, Homo sapiens
MAGFSPWRRRQRRRRRRRRARQSRAAPELVGDLGSFLLLGSTFLSTARHCFITSVEIVSRYLCARGSGRAGHHGPGRARPAVATSAFPAQEPRVFLRSALPAGRLSPSTTHLHLVTADNPAANWLHARSTRKKRCPYTKHQTLELEKEFLFNMYLTRDRRYEVARLLNLTERQVKIWFQNRRMKMKKINKDRAKDE

SEQ ID NO: 49293 - protein, 301 aa, Homo sapiens
MDYNRMNSFLEYPLCNRGPSAYSAHSAPTSFPPSSAQAVDSYASEGRYGGGLSSPAFQQNSGYPAQQPPSTLGVPFPSSAPSGYAPAACSPSYGPSQYYPLGQSEGDGGYFHPSSYGAQLGGLSDGYGAGGAGPGPYPPQHPPYGNEQTASFAPAYADLLSEDKETPCPSEPNTPTARTFDWMKVKRNPPKTAKVSEPGLGSPSGLRTNFTTRQLTELEKEFHFNKYLSRARRVEIAATLELNETQVKIWFQNRRMKQKKREREEGRVPPAPPGCPKEAAGDASDQSTCTSPEASPSSVTS

SEQ ID NO: 49294 - protein, 284 aa, Homo sapiens
MEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPCAQAATLAAYPAETPTAGEEYPSRPTEFAFYPGYPGTYQPMASYLDVSVVQTLGAPGEPRHDSLLPVDSYQSWALAGGWNSQMCCQGEQNPPGPFWKAAFADSSGQHPPDACAFRRGRKKRIPYSKGQLRELEREYAANKFITKDKRRKISAATSLSERQITIWFQNRRVKEKKVLAKVKNSATP

SEQ ID NO: 49295 - protein, 176 aa, Homo sapiens
PRCPPGPRVPLDEREEIRQETQPIRHVSFSGRLRRSGGVGSPADGLGRRLVAAGQAAHGLHQHAAAGTGEFHFNKYLCRPRRVEIAALLDLTERQVKVWFQNRRMKHKRQTQHREPPDGEPACPGALEDICDPAEEPAASPGGPLAGGVGSLLSPAGGGAGGLKRGPPAFSRSLRG

SEQ ID NO: 49296 - protein, 356 aa, Homo sapiens
MNFEFEREIGFINSQPSLAECLTSFPAVLETFQTSSIKESTLIPPPPPFEQTFPSLQPGASTLQRPRSQKRAEDGPALPPPPPPPLPAAPPAPEFPWMKEKKSAKKPSQSATSPSPAASAVPASGVGSPADGLGLPEAGGGGARRLRTAYTNTQLLELEKEFHFNKYLCRPRRVEIAALLDLTERQVKVWFQNRRMKHKRQTQHREPPDGEPACPGALEDICDPAEEPAASPGGPSASRAAWEACCHPPEVVPGALSADPRPLAVRLEGAGASSPGCALRGAGGLEPGPLPEDVFSGRQDSPFLPDLNFFAADSCLQLSGGLSPSLQGSLDSPVPFSEEELDFFTSTLCAIDLQFP

SEQ ID NO: 49297 - protein, 431 aa, Homo sapiens
MQKATYYDNAAAALFGGYSSYPGSNGFGFDVPPQPPFQAATHLEGDYQRSACSLQSLGNAAPHAKSKELNGSCMRPGLAPEPLSAPPGSPPPSAAPTSATSNSSNGGGPSKSGPPKCGPGTNSTLTKQIFPWMKESRQTSKLKNNSPGTAEGCGGGGGGGGGGGSGGSGGGGGGGGGGDKSPPGSAASKRARTAYTSAQLVELEKEFHFNRYLCRPRRVEMANLLNLSERQIKIWFQNRRMKYKKDQKAKGLASSSGGPSPAGSPPQPMQSTAGFMNALHSMTPSYESPSPPAFGKAHQNAYALPSNYQPPLKGCGAPQKYPPTPAPEYEPHVLQANGGAYGTPTMQGSPVYVGGGGYADPLPPPAGPSLYGLNHLSHHPSGNLDYNGAPPMAPSQHHGPCEPHPTYTDLSSHHAPPPQGRIQEAPKLTHL

SEQ ID NO: 49298 - protein, 299 aa, Homo sapiens
MKESRQTSKLKNNSPGTAEGCGGGGGGGGGGGSGGSGGGGGGGGGGDKSPPGSAASKRARTAYTSAQLVELEKEFHFNRYLCRPRRVEMANLLNLSERQIKIWFQNRRMKYKKDQKAKGLASSSGGPSPAGSPPQPMQSTAGFMNALHSMTPSYESPSPPAFGKAHQNAYALPSNYQPPLKGCGAPQKYPPTPAPEYEPHVLQANGGAYGTPTMQGSPVYVGGGGYADPLPPPAGPSLYGLNHLSHHPSGNLDYNGAPPMAPSQHHGPCEPHPTYTDLSSHHAPPPQGRIQEAPKLTHL

SEQ ID NO: 49299 - protein, 431 aa, Homo sapiens; identical to SEQ ID NO: 49297

SEQ ID NO: 49300 - protein, 358 aa, Homo sapiens
MRPGLAPEPLSAPPGSPPPSAAPTSATSNSSNGGGPSKSGPPKCGPGTNSTLTKQIFPWMKESRQTSKLKNNSPGTAEGCGGGGGGGGGGGSGGSGGGGGGGGGGDKSPPGSAASKRARTAYTSAQLVELEKEFHFNRYLCRPRRVEMANLLNLSERQIKIWFQNRRMKYKKDQKAKGLASSSGGPSPAGSPPQPMQSTAGFMNALHSMTPSYESPSPPAFGKAHQNAYALPSNYQPPLKGCGAPQKYPPTPAPEYEPHVLQANGGAYGTPTMQGSPVYVGGGGYADPLPPPAGPSLYGLNHLSHHPSGNLDYNGAPPMAPSQHHGPCEPHPTYTDLSSHHAPPPQGRIQEAPKLTHL

SEQ ID NO: 49301 - protein, 431 aa, Homo sapiens; identical to SEQ ID NO: 49297

SEQ ID NO: 49302 - protein, 299 aa, Homo sapiens; identical to SEQ ID NO: 49298

SEQ ID NO: 49303 - protein, 358 aa, Homo sapiens; identical to SEQ ID NO: 49300

SEQ ID NO: 49304 - protein, 431 aa, Homo sapiens; identical to SEQ ID NO: 49297

SEQ ID NO: 49305 - protein, 251 aa, Homo sapiens
MAMSSFLINSNYVDPKFPPCEEYSQSDYLPSDHSPGYYAGGQRRESSFQPEAGFGRRAACTVQRYAACRDPGPPPPPPPPPPPPPPPGLSPRAPAPPPAGALLPEPGQRCEAVSSSPPPPPCAQNPLHPSPSHSACKEPVVYPWMRKVHVSTVNPNYAGGEPKRSRTAYTRQQVLELEKEFHYNRYLTRRRRVEIAHALCLSERQIKIWFQNRRMKWKKDHKLPNTKIRSGGAAGSAGGPPGRPNGGPRAL

SEQ ID NO: 49306 - protein, 269 aa, Homo sapiens
MSSYFVNSFSGRYPNGPDYQLLNYGSGSSLSGSYRDPAAMHTGSYGYNYNGMDLSVNRSSASSSHFGAVGESSRAFPAPAQEPRFRQAASSCSLSSPESLPCTNGDSHGAKPSASSPSDQATSASSSANFTEIDEASASSEPEEAASQLSSPSLARAQPEPMATSTAAPEGQTPQIFPWMRKLHISHDMTGPDGKRARTAYTRYQTLELEKEFHFNRYLTRRRRIEIAHALCLSERQIKIWFQNRRMKWKKDNKLKSMSLATAGSAFQP

SEQ ID NO: 49307 - protein, 224 aa, Homo sapiens
MSSYFVNSTFPVTLASGQESFLGQLPLYSSGYADPLRHYPAPYGPGPGQDKGFATSSYYPPAGGGYGRAAPCDYGPAPAFYREKESACALSGADEQPPFHPEPRKSDCAQDKSVFGETEEQKCSTPVYPWMQRMNSCNSSSFGPSGRRGRQTYTRYQTLELEKEFHYNRYLTRRRRIEIAHALCLTERQIKIWFQNRRMKWKKESKLLSASQLSAEEEEEKQAE

SEQ ID NO: 49308 - protein, 224 aa, Homo sapiens; identical to SEQ ID NO: 49307

SEQ ID NO: 49309 - protein, 217 aa, Homo sapiens
MSSLYYANTLFSKYPASSSVFATGAFPEQTSCAFASNPQRPGYGAGSGASFAASMQGLYPGGGGMAGQSAAGVYAAGYGLEPSSFNMHCAPFEQNLSGVCPGDSAKAAGAKEQRDSDLAAESNFRIYPWMRSSGTDRKRGRQTYTRYQTLELEKEFHYNRYLTRRRRIEIAHTLCLTERQIKIWFQNRRMKWKKENKTAGPGTTGQDRAEAEEEEEE

SEQ ID NO: 49310 - protein, 28 aa, Homo sapiens
MKWKKENKTAGPGTTGQDRAEAEEEEEE

SEQ ID NO: 49311 - protein, 243 aa, Homo sapiens
MSSYFVNSLFSKYKTGESLRPNYYDCGFAQDLGGRPTVVYGPSSGGSFQHPSQIQEFYHGPSSLSTAPYQQNPCAVACHGDPGNFYGYDPLQRQSLFGAQDPDLVQYADCKLAAASGLGEEAEGSEQSPSPTQLFPWMRPQAAAGRRRGRQTYSRYQTLELEKEFLFNPYLTRKRRIEVSHALGLTERQVKIWFQNRRMKWKKENNKDKFPSSKCEQEELEKQKLERAPEAADEGDAQKGDKK

SEQ ID NO: 49312 - protein, 250 aa, Homo sapiens
MSISGTLSSYYVDSIISHESEDAPPAKFPSGQYASSRQPGHAEHLEFPSCSFQPKAPVFGASWAPLSPHASGSLPSVYHPYIQPQGVPPAESRYLRTWLEPAPRGEAAPGQGQAAVKAEPLLGAPGELLKQGTPEYSLETSAGREAVLSNQRPGYGDNKICEGSEDKERPDQTNPSANWLHARSSRKKRCPYTKYQTLELEKEFLFNMYLTRDRRHEVARLLNLSERQVKIWFQNRRMKMKKMNKEQGKE

SEQ ID NO: 49313 - protein, 128 aa, Homo sapiens
MSISGTLSSYYVDSIISHESEDAPPAKFPSGQYASSRQPGHAEHLEFPSCSFQPKAPVFGASWAPLSPHASGSLPSVYHPYIQPQGVPPAESRYLRTWLEPAPRGGAAQTGHARVQFGNFGGQGGRAV

SEQ ID NO: 49314 - protein, 342 aa, Homo sapiens
MTCPRNVTPNSYAEPLAAPGGGERYSRSAGMYMQSGSDFNCGVMRGCGLAPSLSKRDEGSSPSLALNTYPSYLSQLDSWGDPKAAYRLEQPVGRPLSSCSYPPSVKEENVCCMYSAEKRAKSGPEAALYSHPLPESCLGEHEVPVPSYYRASPSYSALDKTPHCSGANDFEAPFEQRASLNPRAEHLESPQLGGKVSFPETPKSDSQTPSPNEIKTEQSLAGPKGSPSESEKERAKAADSSPDTSDNEAKEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 49315 - protein, 304 aa, Homo sapiens
MFNSVNLGNFCSPSRKERGADFGERGSCASNLYLPSCTYYMPEFSTVSSFLPQAPSRQISYPYSAQVPPVREVSYGLEPSGKWHHRNSYSSCYAAADELMHRECLPPSTVTEILMKNEGSYGGHHHPSAPHATPAGFYSSVNKNSVLPQAFDRFFDNAYCGGGDPPAEPPCSGKGEAKGEPEAPPASGLASRAEAGAEAEAEEENTNPSSSGSAHSVAKEPAKGAAPNAPRTRKKRCPYSKFQIRELEREFFFNVYINKEKRLQLSRMLNLTDRQVKIWFQNRRMKEKKLSRDRLQYFSGNPLL

SEQ ID NO: 49316 - protein, 282 aa, Homo sapiens
MGEHNLLNPGFVGPLVNIHTGDTFYFPNFRASGAQLPGLPSLSYPRRDNVCSLSWPSAEPCNGYPQPYLGSPVSLNPPFGRTCELARVEDGKGYYREPCAEGGGGGLKREERGRDPGAGPGAALLPLEPSGPPALGFKYDYAAGGGGGDGGGGAGPPHDPPSCQSLESDSSSSLLNEGNKGAGAGDPGSLVSPLNPGGGLSASGAPWYPINSRSRKKRKPYSKLQLAELEGEFLVNEFITRQRRRELSDRLNLSDQQVKIWFQNRRMKKKRLLLREQALSFF

SEQ ID NO: 49317 - protein, 330 aa, Homo sapiens
MTTSLLLHPRWPESLMYVYEDSAAESGIGGGGGGGGGGTGGAGGGCSGASPGKAPSMDGLGSSCPASHCRDLLPHPVLGRPPAPLGAPQGAVYTDIPAPEAARQCAPPPAPPTSSSATLGYGYPFGGSYYGCRLSHNVNLQQKPCAYHPGDKYPEPSGALPGDDLSSRAKEFAFYPSFASSYQAMPGYLDVSVVPGISGHPEPRHDALIPVEGYQHWALSNGWDSQVYCSKEQSQSAHLWKSPFPDVVPLQPEVSSYRRGRKKRVPYTKVQLKELEKEYAASKFITKEKRRRISATTNLSERQVTIWFQNRRVKEKKVVSKSKAPHLHST

SEQ ID NO: 49318 - protein, 264 aa, Homo sapiens
MIMSSYLMDSNYIDPKFPPCEEYSQNSYIPEHSPEYYGRTRESGFQHHHQELYPPPPPRPSYPERQYSCTSLQGPGNSRGHGPAQAGHHHPEKSQSLCEPAPLSGASASPSPAPPACSQPAPDHPSSAASKQPIVYPWMKKIHVSTVNPNYNGGEPKRSRTAYTRQQVLELEKEFHYNRYLTRRRRIEIAHSLCLSERQIKIWFQNRRMKWKKDHRLPNTKVRSAPPAGAAPSTLSAATPGTSEDHSQSATPPEQQRAEDITRL

SEQ ID NO: 49319 - protein, 264 aa, Homo sapiens; identical to SEQ ID NO: 49318

SEQ ID NO: 49320 - protein, 222 aa, Homo sapiens
MSSYVANSFYKQSPNIPAYNMQTCGNYGSASEVQASRYCYGGLDLSITFPPPAPSNSLHGVDMAANPRAHPDRPACSAAAAPGHAPGRDEAAPLNPGMYSQKAARPALEERAKSSGEIKEEQAQTGQPAGLSQPPAPPQIYPWMTKLHMSHETDGKRSRTSYTRYQTLELEKEFHFNRYLTRRRRIEIANNLCLNERQIKIWFQNRRMKWKKDSKMKSKEAL

SEQ ID NO: 49321 - protein, 235 aa, Homo sapiens
MNSYFTNPSLSCHLAGGQDVLPNVALNSTAYDPVRHFSTYGAAVAQNRIYSTPFYSPQENVVFSSSRGPYDYGSNSFYQEKDMLSNCRQNTLGHNTQTSIAQDFSSEQGRTAPQDQKASIQIYPWMQRMNSHSGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 49322 - protein, 153 aa, Homo sapiens
MLSNCRQNTLGHNTQTSIAQDFSSEQGRTAPQDQKASIQIYPWMQRMNSHSGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 49323 - protein, 52 aa, Homo sapiens
MLSNCRQNTLGHNTQTSIAQDFSSEQGRTAPQDQKASIQIYPWMQRMNSHSG

SEQ ID NO: 49324 - protein, 71 aa, Homo sapiens
MLSNCRQNTLGHNTQTSIAQDFSSEQGRTAPQDQKASIQIYPWMQRMNSHSVCFVPGSLGVGYGADRRRGR

SEQ ID NO: 49325 - protein, 242 aa, Homo sapiens
MSSYFVNPLFSKYKAGESLEPAYYDCRFPQSVGRSHALVYGPGGSAPGFQHASHHVQDFFHHGTSGISNSGYQQNPCSLSCHGDASKFYGYEALPRQSLYGAQQEASVVQYPDCKSSANTNSSEGQGHLNQNSSPSLMFPWMRPHAPGRRSGRQTYSRYQTLELEKEFLFNPYLTRKRRIEVSHALGLTERQVKIWFQNRRMKWKKENNKDKLPGARDEEKVEEEGNEEEEKEEEEKEENKD

SEQ ID NO: 49326 - protein, 260 aa, Homo sapiens
MSATGPISNYYVDSLISHDNEDLLASRFPATGAHPAAARPSGLVPDCSDFPSCSFAPKPAVFSTSWAPVPSQSSVVYHPYGPQPHLGADTRYMRTWLEPLSGAVSFPSFPAGGRHYALKPDAYPGRRADCGPGEGRSYPDYMYGSPGELRDRAPQTLPSPEADALAGSKHKEEKADLDPSNPVANWIHARSTRKKRCPYTKYQTLELEKEFLFNMYLTRDRRYEVARVLNLTERQVKIWFQNRRMKMKKMNKEKTDKEQS

SEQ ID NO: 49327 - protein, 260 aa, Homo sapiens; identical to SEQ ID NO: 49326

SEQ ID NO: 49328 - protein, 328 aa, Homo sapiens
MSSYLEYVSCSSSGGVGGDVLSLAPKFCRSDARPVALQPAFPLGNGDGAFVSCLPLAAARPSPSPPAAPARPSVPPPAAPQYAQCTLEGAYEPGAAPAAAAGGADYGFLGSGPAYDFPGVLGRAADDGGSHVHYATSAVFSGGGSFLLSGQVDYAAFGEPGPFPACLKASADGHPGAFQTASPAPGTYPKSVSPASGLPAAFSTFEWMKVKRNASKKGKLAEYGAASPSSAIRTNFSTKQLTELEKEFHFNKYLTRARRIEIANCLHLNDTQVKIWFQNRRMKQKKREREGLLATAIPVAPLQLPLSGTTPTKFIKNPGSPSQSQEPS

SEQ ID NO: 49329 - protein, 209 aa, Homo sapiens
LERAARVERAGGAAQTAAVLLSLCPAPYSGPGLRPHLAFAPGRPRAAVRTASGRAPVRAVHPGGGLRTWCRTCRGSWGRGLRLPGVRAGVRLPGRAGAGGPFPACLKASADGHPGAFQTASPAPGTYPKSVSPASGLPAAFSTFEWMKVKRNASKKDSGLGFVEETRSRANSMESASSTDSENVPGIEKISGRSSPWNFSWQTRRVWGR

SEQ ID NO: 49330 - protein, 340 aa, Homo sapiens
MSFPNSSPAANTFLVDSLISACRSDSFYSSSASMYMPPPSADMGTYGMQTCGLLPSLAKREVNHQNMGMNVHPYIPQVDSWTDPNRSCRIEQPVTQQVPTCSFTTNIKEESNCCMYSDKRNKLISAEVPSYQRLVPESCPVENPEVPVPGYFRLSQTYATGKTQEYNNSPEGSSTVMLQLNPRGAAKPQLSAAQLQMEKKMNEPVSGQEPTKVSQVESPEAKGGLPEERSCLAEVSVSSPEVQEKESKEEIKSDTPTSNWLTAKSGRKKRCPYTKHQTLELEKEFLFNMYLTRERRLEISKSVNLTDRQVKIWFQNRRMKLKKMSRENRIRELTANLTFS

SEQ ID NO: 49331 - protein, 338 aa, Homo sapiens
MNDFDECGQSAASMYLPGCAYYVAPSDFASKPSFLSQPSSCQMTFPYSSNLAPHVQPVREVAFRDYGLERAKWPYRGGGGGGSAGGGSSGGGPGGGGGGAGGYAPYYAAAAAAAAAAAAAEEAAMQRELLPPAGRRPDVLFKAPEPVCAAPGPPHGPAGAASNFYSAVGRNGILPQGFDQFYEAAPGPPFAGPQPPPPPAPPQPEGAADKGDPRTGAGGGGGSPCTKATPGSEPKGAAEGSGGDGEGPPGEAGAEKSSSAVAPQRSRKKRCPYTKYQIRELEREFFFNVYINKEKRLQLSRMLNLTDRQVKIWFQNRRMKEKKLNRDRLQYFTGNPLF

SEQ ID NO: 49332 - protein, 159 aa, Homo sapiens
MYLPGCAYYVAPSDFASKPSFLSQPSSCQMTFPYSSNLAPGGGSPCTKATPGSEPKGAAEGSGGDGEGPPGEAGAEKSSSAVAPQRSRKKRCPYTKYQIRELEREFFFNVYINKEKRLQLSRMLNLTDRQVKIWFQNRRMKEKKLNRDRLQYFTGNPLF

SEQ ID NO: 49333 - protein, 270 aa, Homo sapiens
MCERSLYRAGYVGSLLNLQSPDSFYFSNLRPNGGQLAALPPISYPRGALPWAATPASCAPAQPAGATAFGGFSQPYLAGSGPLGLQPPTAKDGPEEQAKFYAPEAAAGPEERGRTRPSFAPESSLAPAVAALKAAKYDYAGVGRATPGSTTLLQGAPCAPGFKDDTKGPLNLNMTVQAAGVASCLRPSLPDGLPWGAAPGRARKKRKPYTKQQIAELENEFLVNEFINRQKRKELSNRLNLSDQQVKIWFQNRRMKKKRVVLREQALALY

SEQ ID NO: 49334 - protein, 432 aa, Homo sapiens
MLFEQGQQALELPECTMQKAAYYENPGLFGGYGYSKTTDTYGYSTPHQPYPPPAAASSLDTDYPGSACSIQSSAPLRAPAHKGAELNGSCMRPGTGNSQGGGGGSQPPGLNSEQQPPQPPPPPPTLPPSSPTNPGGGVPAKKPKGGPNASSSSATISKQIFPWMKESRQNSKQKNSCATAGESCEDKSPPGPASKRVRTAYTSAQLVELEKEFHFNRYLCRPRRVEMANLLNLTERQIKIWFQNRRMKYKKDQKAKGILHSPASQSPERSPPLGGAAGHVAYSGQLPPVPGLAYDAPSPPAFAKSQPNMYGLAAYTAPLSSCLPQQKRYAAPEFEPHPMASNGGGFASANLQGSPVYVGGNFVESMAPASGPVFNLGHLSHPSSASVDYSCAAQIPGNHHHGPCDPHPTYTDLSAHHSSQGRLPEAPKLTHL

SEQ ID NO: 49335 - protein, 432 aa, Homo sapiens; identical to SEQ ID NO: 49334

SEQ ID NO: 49336 - protein, 100 aa, Homo sapiens
MLFEQGQQALELPECTMQKAAYYENPGLFGGYGYSKTTDTYGYSTPHQPYPPPAAASSLDTDYPGSACSIQSSAPLRAPAHKGAELNGSCMRPGTGNSQG

SEQ ID NO: 49337 - protein, 432 aa, Homo sapiens; identical to SEQ ID NO: 49334

SEQ ID NO: 49338 - protein, 255 aa, Homo sapiens
MVMSSYMVNSKYVDPKFPPCEEYLQGGYLGEQGADYYGGGAQGADFQPPGLYPRPDFGEQPFGGSGPGPGSALPARGHGQEPGGPGGHYAAPGEPCPAPPAPPPAPLPGARAYSQSDPKQPPSGTALKQPAVVYPWMKKVHVNSVNPNYTGGEPKRSRTAYTRQQVLELEKEFHFNRYLTRRRRIEIAHTLCLSERQIKIWFQNRRMKWKKDHKLPNTKGRSSSSSSSSSCSSSVAPSQHLQPMAKDHHTDLTTL

SEQ ID NO: 49339 - protein, 290 aa, Homo sapiens
MSSYFVNPLYSKYKAAAAAAAAAGEAINPTYYDCHFAPEVGGRHAAAAAALQLYGNSAAGFPHAPPQAHAHPHPSPPPSGTGCGGREGRGQEYFHPGGGSPAAAYQAAPPPPPHPPPPPPPPPCGGIACHGEPAKFYGYDNLQRQPIFTTQQEAELVQYPDCKSSSGNIGEDPDHLNQSSSPSQMFPWMRPQAAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 49340 - protein, 289 aa, Homo sapiens
MSSYFVNPLYSKYKAAAAAAAAAGEAINPTYYDCHFAPEVGGRHAAAAAALQLYGNSAAGFPHAPPQAHAHPHPSPPPSGTGCGGREGRGQEYFHPGGGSPAAAYQAAPPPPPHPPPPPPPPPCGGIACHGEPAKFYGYDNLQRQPIFTTQQEAELVQYPDCKSSSGNIGEDPDHLNQSSSPSQMFPWMRPQAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 49341 - protein, 289 aa, Homo sapiens; identical to SEQ ID NO: 49340

SEQ ID NO: 49342 - protein, 106 aa, Homo sapiens
MFPWMRPQAAPGRRRGRQTYSRFQTLELEKEFLFNPYLTRKRRIEVSHALALTERQVKIWFQNRRMKWKKENNKDKFPVSRQEVKDGETKKEAQELEEDRAEGLTN

SEQ ID NO: 49343 - protein, 352 aa, Homo sapiens
MLGGSAGRLKMSSSGTLSNYYVDSLIGHEGDEVFAARFGPPGPGAQGRPAGVADGPAATAAEFASCSFAPRSAVFSASWSAVPSQPPAAAAMSGLYHPYVPPPPLAASASEPGRYVRSWMEPLPGFPGGAGGGGGGGGGGPGRGPSPGPSGPANGRHYGIKPETRAAPAPATAASTTSSSSTSLSSSSKRTECSVARESQGSSGPEFSCNSFLQEKAAAATGGTGPGAGIGAATGTGGSSEPSACSDHPIPGCSLKEEEKQHSQPQQQQLDPNNPAANWIHARSTRKKRCPYTKYQTLELEKEFLFNMYLTRDRRYEVARILNLTERQVKIWFQNRRMKMKKMSKEKCPKGD

SEQ ID NO: 49344 - protein, 918 aa, Homo sapiens
LQPVYESMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNHPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQAPSSTSATISLANPEVSILNYPSTLYQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSQRKNVISCVTVHDSPYSDSSSNTSPYSVQQRAGHNNANAFDTKGSLENHCTGNPRTIIVPPLKTQASEVLVECDSLVPGNLGPGQGRNLSLESGFPAFLLLEMLLYGS

SEQ ID NO: 49345 - protein, 1198 aa, Homo sapiens
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNHPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQAPSSTSATISLANPEVSILNYPSTLYQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 49346 - protein, 1171 aa, Homo sapiens
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNHPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 49347 - protein, 1215 aa, Homo sapiens
MASQVLVYPPYVYQTQSSAFCSVKKLKVEPSSCVFQERNYPRTYVNGRNFGNSHPPTKGSAFQTKIPFNRPRGHNFSLQTSAVVLKNTAGATKVIAAQAQQAHVQAPQIGAWRNRLHFLEGPQRCGLKRKSEELDNHSSAMQIVDELSILPAMLQTNMGNPVTVVTATTGSKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRAPEIILGLPFCEAIDMWSLGCVIAELFLGWPLYPGALEYDQIRYISQTQGLPGEQLLNVGTKSTRFFCKETDMSHSGWRLKTLEEHEAETGMKSKEARKYIFNSLDDVAHVNTVMDLEGSDLLAEKADRREFVSLLKKMLLIDADLRITPAETLNHPFVNMKHLLDFPHSNHVKSCFHIMDICKSHLNSCDTNNHNKTSLLRPVASSSTATLTANFTKIGTLRSQALTTSAHSVVHHGIPLQAGTAQFGCGDAFQQTLIICPPAIQGIPATHGKPTSYSIRVDNTVPLVTQAPAVQPLQIRPGVLSQTWSGRTQQMLVPAWQQVTPLAPATTTLTSESVAGSHRLGDWGKMISCSNHYNSVMPQPLLTNQITLSAPQPVSVGIAHVVWPQPATTKKNKQCQNRGILVKLMEWEPGREEINAFSWSNSLQNTNIPHSAFISPKIINGKDVEEVSCIETQDNQNSEGEARNCCETSIRQDSDSSVSDKQRQTIIIADSPSPAVSVITISSDTDEEETSQRHSLRECKGSLDCEACQSTLNIDRMCSLSSPDSTLSTSSSGQSSPSPCKRPNSMSDEEQESSCDTVDGSPTSDSSGHDSPFAESTFVEDTHENTELVSSADTETKPAVCSVVVPPVELENGLNADEHMANTDSICQPLIKGRSAPGRLNQPSAVGTRQQKLTSAFQQQHLNFSQVQHFGSGHQEWNGNFGHRRQQAYIPTSVTSNPFTLSHGSPNHTAVHAHLAGNTHLGGQPTLLPYPSSATLSSAAPVAHLLASPCTSRPMLQHPTYNISHPSGIVHQVPVGLNPRLLPSPTIHQTQYKPIFPPHSYIAASPAYTGFPLSPTKLSQYPYM

SEQ ID NO: 49348 - protein, 1194 aa, Homo sapiens
MASQVLVYPPYVYQTQSSAFCSVKKLKVEPSSCVFQERNYPRTYVNGRNFGNSHPPTKGSAFQTKIPFNRPRGHNFSLQTSAVVLKNTAGATKVIAAQAQQAHVQAPQIGAWRNRLHFLEGPQRCGLKRKSEELDNHSSAMQIVDELSILPAMLQTNMGNPVTVVTATTGSKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRAPEIILGLPFCEAIDMWSLGCVIAELFLGWPLYPGALEYDQIRYISQTQGLPGEQLLNVGTKSTRFFCKETDMSHSGWRLKTLEEHEAETGMKSKEARKYIFNSLDDVAHVNTVMDLEGSDLLAEKADRREFVSLLKKMLLIDADLRITPAETLNHPFVNMKHLLDFPHSNHVKSCFHIMDICKSHLNSCDTNNHNKTSLLRPVASSSTATLTANFTKIGTLRSQALTTSAHSVVHHGIPLQAGTAQFGCGDAFQQTLIICPPAIQGIPATHGKPTSYSIRVDNTVPLVTQAPAVQPLQIRPGVLSQTWSGRTQQMLVPAWQQVTPLAPATTTLTSESVAGSHRLGDWGKMISCSNHYNSVMPQPLLTNQITLSAPQPVSVGIAHVVWPQPATTKKNKQCQNRSNSLQNTNIPHSAFISPKIINGKDVEEVSCIETQDNQNSEGEARNCCETSIRQDSDSSVSDKQRQTIIIADSPSPAVSVITISSDTDEEETSQRHSLRECKGSLDCEACQSTLNIDRMCSLSSPDSTLSTSSSGQSSPSPCKRPNSMSDEEQESSCDTVDGSPTSDSSGHDSPFAESTFVEDTHENTELVSSADTETKPAVCSVVVPPVELENGLNADEHMANTDSICQPLIKGRSAPGRLNQPSAVGTRQQKLTSAFQQQHLNFSQVQHFGSGHQEWNGNFGHRRQQAYIPTSVTSNPFTLSHGSPNHTAVHAHLAGNTHLGGQPTLLPYPSSATLSSAAPVAHLLASPCTSRPMLQHPTYNISHPSGIVHQVPVGLNPRLLPSPTIHQTQYKPIFPPHSYIAASPAYTGFPLSPTKLSQYPYM

SEQ ID NO: 49349 - protein, 1194 aa, Homo sapiens; identical to SEQ ID NO: 49348

SEQ ID NO: 49350 - protein, 1194 aa, Homo sapiens; identical to SEQ ID NO: 49348

SEQ ID NO: 49351 - protein, 76 aa, Homo sapiens
MASQVLVYPPYVYQTQSSAFCSVKKLKVEPSSCVFQERNYPRTYVNGRNFGNSHPPTKGSAFQTKIPFNRPRGHNF

SEQ ID NO: 49352 - protein, 616 aa, Homo sapiens
MSTIQSETDCYDIIEVLGKGTFGEVAKGWRRSTGEMVAIKILKNDAYRNRIIKNELKLLHCMRGLDPEEAHVIRFLEFFHDALKFYLVFELLEQNLFEFQKENNFAPLPARHIRTVTLQVLTALARLKELAIIHADLKPENIMLVDQTRCPFRVKVIDFGSASIFSEVRYVKEPYIQSRFYRAPEILLGLPFCEKVDVWSLGCVMAELHLGWPLYPGNNEYDQVRYICETQGLPKPHLLHAACKAHHFFKRNPHPDAANPWQLKSSADYLAETKVRPLERRKYMLKSLDQIETVNGGSVASRLTFPDREALAEHADLKSMVELIKRMLTWESHERISPSAALRHPFVSMQQLRSAHETTHYYQLSLRSYRLSLQVEGKPPTPVVAAEDGTPYYCLAEEKEAAGMGSVAGSSPFFREEKAPGMQRAIDQLDDLSLQEAGHGLWGETCTNAVSDMMVPLKAAITGHHVPDSGPEPILAFYSSRLAGRHKARKPPAGSKSDSNFSNLIRLSQVSPEDDRPCRGSSWEEGEHLGASAEPLAILQRDEDGPNIDNMTMEAERPDPELFDPSSCPGEWLSEPDCTLESVRGPRAQGLPPRRSHQHGPPRGATSFLQHVTGHH

SEQ ID NO: 49353 - protein, 581 aa, Homo sapiens
MVAIKILKNDAYRNRIIKNELKLLHCMRGLDPEEAHVIRFLEFFHDALKFYLVFELLEQNLFEFQKENNFAPLPARHIRTVTLQVLTALARLKELAIIHADLKPENIMLVDQTRCPFRVKVIDFGSASIFSEVRYVKEPYIQSRFYRAPEILLGLPFCEKVDVWSLGCVMAELHLGWPLYPGNNEYDQVRYICETQGLPKPHLLHAACKAHHFFKRNPHPDAANPWQLKSSADYLAETKVRPLERRKYMLKSLDQIETVNGGSVASRLTFPDREALAEHADLKSMVELIKRMLTWESHERISPSAALRHPFVSMQQLRSAHETTHYYQLSLRSYRLSLQVEGKPPTPVVAAEDGTPYYCLAEEKEAAGMGSVAGSSPFFREEKAPGMQRAIDQLDDLSLQEAGHGLWGETCTNAVSDMMVPLKAAITGHHVPDSGPEPILAFYSSRLAGRHKARKPPAGSKSDSNFSNLIRLSQVSPEDDRPCRGSSWEEGEHLGASAEPLAILQRDEDGPNIDNMTMEAERPDPELFDPSSCPGEWLSEPDCTLESVRGPRAQGLPPRRSHQHGPPRGATSFLQHVTGHH

SEQ ID NO: 49354 - protein, 224 aa, Homo sapiens
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 49355 - protein, 354 aa, Homo sapiens
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKFAEKFQEFKEAARLAKEKSQEKMELTSTPSQESAGGDLQSPLTPESINGTDDERTPDVTQNSEPRAEPTQNALPFSHSSAISKHWEAELATLKGNNAKLTAALLESTANVKQWKQQLAAYQEEAERLHKRVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 49356 - protein, 177 aa, Homo sapiens
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKFAEKFQEFKEAARLAKEKSQEKMELTSTPSQESAGGDLQSPLTPESINGTDDERTPDVTQNSEPRAEPTQNALPFSHRK

SEQ ID NO: 49357 - protein, 180 aa, Homo sapiens
MGSAISKHWEAELATLKGNNAKLTAALLESTANVKQWKQQLAAYQEEAERLHKRVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 49358 - protein, 354 aa, Homo sapiens
MGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQESGRETPSSTQASSVNGTDDEKASHAGPANTHLKSENDKLKIALTQSAANVKKWEIELQTLRESNARLTTALQESAASVEQWKRQFSICRDENDRLRNKIDELEEQCSEINREKEKNTQLKRRIEELEAELREKETELKDLRKQSEIIPQLMSECEYVSEKLEAAERDNQNLEDKVRSLKTDIEESKYRQRHLKVELKSFLEVLDGKIDDLHDFRRGLSKLGTDN

SEQ ID NO: 49359 - protein, 288 aa, Homo sapiens
MGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQASSVNGTDDEKASHAGPANTHLKSENDKLKIALTQSAANVKNEINREKEKNTQLKRRIEELEAELREKETELKDLRKQSEIIPQLMSECEYVSEKLEAAERDNQNLEDKVRSLKTDIEESKYRQRHLKVELKSFLEVLDGKIDDLHDFRRGLSKLGTDN

SEQ ID NO: 49360 - protein, 299 aa, Homo sapiens
MGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQESGRETPSSTQASSVNGTDDEKASHAGPANTHLKSENDKLKIALTQSAANVKNEINREKEKNTQLKRRIEELEAELREKETELKDLRKQSEIIPQLMSECEYVSEKLEAAERDNQNLEDKVRSLKTDIEESKYRQRHLKVELKSFLEVLDGKIDDLHDFRRGLSKLGTDN

SEQ ID NO: 49361 - protein, 343 aa, Homo sapiens
MGEQPIFTTRAHVFQIDPNTKKNWMPASKQAVTVSYFYDVTRNSYRIISVDGAKVIINSTITPNMTFTKTSQKFGQWADSRANTVFGLGFSSEQQLTKFAEKFQEVKEAAKIAKDKTQEKIETSSNHSQASSVNGTDDEKASHAGPANTHLKSENDKLKIALTQSAANVKKWEIELQTLRESNARLTTALQESAASVEQWKRQFSICRDENDRLRNKIDELEEQCSEINREKEKNTQLKRRIEELEAELREKETELKDLRKQSEIIPQLMSECEYVSEKLEAAERDNQNLEDKVRSLKTDIEESKYRQRHLKVELKSFLEVLDGKIDDLHDFRRGLSKLGTDN

SEQ ID NO: 49362 - protein, 4 aa, Homo sapiens
  MOD_RES (1)..(1): Any amino acid
XTDN

SEQ ID NO: 49363 - protein, 325 aa, Homo sapiens
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVTPTGEKEGLGQGQSLEQLEALVQTKDQEIQTLKSQTGGPREALEAAEREETQQKVQDLETRNAELEHQLRAMERSLEEARAERERARAEVGRAAQLLDVSLFELSELREGLARLAEAAP

SEQ ID NO: 49364 - protein, 358 aa, Homo sapiens
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVTPTGEKEGLGQGQSLEQLEALVQTKDQEIQTLKSQTGGPREALEAAEREETQQKVQTRNAELEHQLRAMERSLEEARAERERARAEVGRAAQLLDVSLFELSELREGLARLAEAAP

SEQ ID NO: 49365 - protein, 145 aa, Homo sapiens
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGWGGPQSALVVGSFGAVFELLIV

SEQ ID NO: 49366 - protein, 361 aa, Homo sapiens
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVTPTGEKEGLGQGQSLEQLEALVQTKDQEIQTLKSQTGGPREALEAAEREETQQKVQDLETRNAELEHQLRAMERSLEEARAERERARAEVGRAAQLLDVSLFELSELREGLARLAEAAP

SEQ ID NO: 49367 - protein, 358 aa, Homo sapiens; identical to SEQ ID NO: 49364

SEQ ID NO: 49368 - protein, 361 aa, Homo sapiens; identical to SEQ ID NO: 49366

SEQ ID NO: 49369 - protein, 361 aa, Homo sapiens; identical to SEQ ID NO: 49366

SEQ ID NO: 49370 - protein, 325 aa, Homo sapiens; identical to SEQ ID NO: 49363

SEQ ID NO: 49371 - protein, 391 aa, Homo sapiens
MESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 49372 - protein, 232 aa, Homo sapiens
MESETEPEPVTLLVKSPNQRHRDLELSGDRGWSVGHLKAHLSRVYPERPRPEDQRLIYSGKLLLDHQCLRDLLPKEKRHVLHLVCNVKSPSKMPEINAKVAESTEEPAGSNRGQYPEDSSSDGLRQREVLRNLSSPGWENISRHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 49373 - protein, 366 aa, Homo sapiens
MESETEPEPVTLLVKSPNQRHRDLELSGDRGWSVGHLKAHLSRVYPERPRPEDQRLIYSGKLLLDHQCLRDLLPKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 49374 - protein, 390 aa, Homo sapiens
MESETEPEPVTLLVKSPNQRHRDLELSGDRGWSVGHLKAHLSRVYPERPRPEDQRLIYSGKLLLDHQCLRDLLPKEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 49375 - protein, 445 aa, Homo sapiens
MAELKYISGFGNECSSEDPRCPGSLPEGQNNPQVCPYNLYAEQLSGSAFTCPRSTNKRSWLYRILPSVSHKPFESIDEGQVTHNWDEVDPDPNQLRWKPFEIPKASQKKVDFVSGLHTLCGAGDIKSNNGLAIHIFLCNTSMENRCFYNSDGDFLIVPQKGNLLIYTEFGKMLVQPNEICVIQRGMRFSIDVFEETRGYILEVYGVHFELPDLGPIGANGLANPRDFLIPIAWYEDRQVPGGYTVINKYQGKLFAAKQDVSPFNVVAWHGNYTPYKYNLKNFMVINSVAFDHADPSIFTVLTAKSVRPGVAIADFVIFPPRWGVADKTFRPPYYHRNCMSEFMGLIRGHYEAKQGGFLPGGGSLHSTMTPHGPDADCFEKASKVKLAPERIADGTMAFMFESSLSLAVTKWGLKASRCLDENYHKCWEPLKSHFTPNSRNPAEPN

SEQ ID NO: 49376 - protein, 728 aa, Homo sapiens
MEETQPPPQPKLPLCDSLMIWLQTFNTASPCQDVKQLTSGVAMAQVLHQIDAAWFNESWLSRIKEDVGDNWRIKASNVKKVLQGIMSYYHEFLGQQISEALIPDLNQITECSDPVELGRLLQLILGCAINCEKKQEHIQNIMTLEESVQHVVMTAIQELMSKEILSSPPNDAVGELEQQLKRALEELQEALAEKEELRQRCEELDMQVTTLQDEKNSLVSENEMMNEKLDQLDGSFDDPNTVVAKKYFHAQLQLEQLQEENFRLEAAKDDYRVHCEELEKQLIEFQHRNDELTSLAEETRALKDEIDVLRATSDKANKLESTVEIYRQKLQDLNDLRKQVKTLQETNMMYMHNTVSLEEELKKANAARTQLETYKRQVQDLHVKLSSESKRADTLAFEMKRLEEKHEALLKEKERLIEQRDTLKETNEELRCSQVQQDHLNQTDASATKSYENLAAEIMPVEYREVFIRLQHENKMLRLQQEGSENERIEELQEQLEQKHRKMNELETEQRLSKERIRELQQQIEDLQKSLQEQGSKSEGESSSKLKQKLEAHMEKLTEVHEELQKKQELIEDLQPDINQNVQKINELEAALQKKDEDMKAMEERYKMYLEKARNVIKTLDPKLNPASAEIMLLRKQLAEKERRIEILESECKVAKFRDYEEKLIVSAWYNKSLAFQKLGMESRLVSGGGACSDTGACTPARSFLAQQRHITNTRRNLSVKVPATTSD

SEQ ID NO: 49377 - protein, 686 aa, Homo sapiens
MAQVLHQIDAAWFNESWLSRIKEDVGDNWRIKASNVKKVLQGIMSYYHEFLGQQISEALIPDLNQITECSDPVELGRLLQLILGCAINCEKKQEHIQNIMTLEESVQHVVMTAIQELMSKEILSSPPNDAVGELEQQLKRALEELQEALAEKEELRQRCEELDMQVTTLQDEKNSLVSENEMMNEKLDQLDGSFDDPNTVVAKKYFHAQLQLEQLQEENFRLEAAKDDYRVHCEELEKQLIEFQHRNDELTSLAEETRALKDEIDVLRATSDKANKLESTVEIYRQKLQDLNDLRKQVKTLQETNMMYMHNTVSLEEELKKANAARTQLETYKRQVQDLHVKLSSESKRADTLAFEMKRLEEKHEALLKEKERLIEQRDTLKETNEELRCSQVQQDHLNQTDASATKSYENLAAEIMPVEYREVFIRLQHENKMLRLQQEGSENERIEELQEQLEQKHRKMNELETEQRLSKERIRELQQQIEDLQKSLQEQGSKSEGESSSKLKQKLEAHMEKLTEVHEELQKKQELIEDLQPDINQNVQKINELEAALQKKDEDMKAMEERYKMYLEKARNVIKTLDPKLNPASAEIMLLRKQLAEKERRIEILESECKVAKFRDYEEKLIVSAWYNKSLAFQKLGMESRLVSGGGACSDTGACTPARSFLAQQRHITNTRRNLSVKVPATTSD

SEQ ID NO: 49378 - protein, 137 aa, Homo sapiens
MEETQPPPQPKLPLCDSLMIWLQTFNTASPCQDVKQLTSGVAMAQVLHQIDAAWFNESWLSRIKEDVGDNWRIKASNVKKVLQGIMSYYHEFLGQQISEALIPDLNQITECSDPVELGRLLQLILGCAINCEKKQEH

SEQ ID NO: 49379 - protein, 717 aa, Homo sapiens
MSVDKAELCGSLLTWLQTFHVPSPCASPQDLSSGLAVAYVLNQIDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDSILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 49380 - protein, 719 aa, Homo sapiens
MSVDKAELCGSLLTWLQTFHVPSPCASPQDLSSGLAVAYVLNQIDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQRQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDAISILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 49381 - protein, 718 aa, Homo sapiens
MFSVESLERAELCESLLTWIQTFNVDAPCQTVEDLTNGVVMAQVLQKIDPAYFDENWLNRIKTEVGDNWRLKISNLKKILKGILDYNHEILGQQINDFTLPDVNLIGEHSDAAELGRMLQLILGCAVNCEQKQEYIQAIMMMEESVQHVVMTAIQELMSKESPVSAGNDAYVDLDRQLKKTTEELNEALSAKEEIAQRCHELDMQVAALQEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVESYKKKLEDLGDLRRQVKLLEEKNTMYMQNTVSLEEELRKANAARSQLETYKRQVVELQNRLSEESKKADKLDFEYKRLKEKVDSLQKEKDRLRTERDSLKETIEELRCVQAQEGQLTTQGLMPLGSQESSDSLAAEIVTPEIREKLIRLQHENKMLKLNQEGSDNEKIALLQSLLDDANLRKNELETENRLVNQRLLEVQSQVEELQKSLQDQGSKAEDSVLLKKKLEEHLEKLHEANNELQKKRAIIEDLEPRFNNSSLKIEELQEALRKKEEEMKQMEERYKKYLEKAKSVIRTLDPKQNQGAAPEIQALKNQLQERDRLFHSLEKEYEKTKSQREMEEKYIVSAWYNMGMTLHKKAAEDRLASTGSGQSFLARQRQATSSRRSYPGHVQPATAR

SEQ ID NO: 49382 - protein, 73 aa, Homo sapiens
MSAETASGPTEDQVEILEYNFNKVDKHPDSTTLCLIAAEAGLSEEETQKWFKQRLAKWRRSEGLPSECRSVTD

SEQ ID NO: 49383 - protein, 73 aa, Homo sapiens; identical to SEQ ID NO: 49382

SEQ ID NO: 49384 - protein, 73 aa, Homo sapiens; identical to SEQ ID NO: 49382

SEQ ID NO: 49385 - protein, 94 aa, Homo sapiens
MSAETASGPTEDQVEILEYNFNKVDKHPDSTTLCLIAAEAGLSEEETQGSDLISRSKIWHPESSPQREGYPHDSLPCLAFDYFSLLPPQCKEMV

SEQ ID NO: 49386 - protein, 91 aa, Homo sapiens
MLIFLGCYRRRLEERAGTMSAETASGPTEDQVEILEYNFNKVDKHPDSTTLCLIAAEAGLSEEETQKWFKQRLAKWRRSEGLPSECRSVTD

SEQ ID NO: 49387 - protein, 73 aa, Homo sapiens; identical to SEQ ID NO: 49382

SEQ ID NO: 49388 - protein, 94 aa, Homo sapiens; identical to SEQ ID NO: 49385

SEQ ID NO: 49389 - protein, 73 aa, Homo sapiens; identical to SEQ ID NO: 49382

SEQ ID NO: 49390 - protein, 91 aa, Homo sapiens; identical to SEQ ID NO: 49386

SEQ ID NO: 49391 - protein, 94 aa, Homo sapiens; identical to SEQ ID NO: 49385

SEQ ID NO: 49392 - protein, 73 aa, Homo sapiens; identical to SEQ ID NO: 49382

SEQ ID NO: 49393 - protein, 73 aa, Homo sapiens; identical to SEQ ID NO: 49382

SEQ ID NO: 49394 - protein, 112 aa, Homo sapiens
MLIFLGCYRRRLEERAGTMSAETASGPTEDQVEILEYNFNKVDKHPDSTTLCLIAAEAGLSEEETQGSDLISRSKIWHPESSPQREGYPHDSLPCLAFDYFSLLPPQCKEMV

SEQ ID NO: 49395 - protein, 73 aa, Homo sapiens; identical to SEQ ID NO: 49382

SEQ ID NO: 49396 - protein, 73 aa, Homo sapiens; identical to SEQ ID NO: 49382

SEQ ID NO: 49397 - protein, 73 aa, Homo sapiens; identical to SEQ ID NO: 49382

SEQ ID NO: 49398 - protein, 47 aa, Homo sapiens
MSAETASGPTEDQVEILEYNFNKVDKHPDSTTLCLIAAEAGLSEEET

SEQ ID NO: 49399 - protein, 387 aa, Homo sapiens
MATAQLQRTPMSALVFPNKISTEHQSLVLVKRLLAVSVSCITYLRGIFPECAYGTRYLDDLCVKILREDKNCPGSTQLVKWMLGCYDALQKKYVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 49400 - protein, 394 aa, Homo sapiens
MATAQLQRTPMSALVFPNKISTEHQSLVLVKRLLAVSVSCITYLRGIFPECAYGTRYLDDLCVKILREDKNCPGSTQLVKWMLGCYDALQKKYLRMVVLAVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 49401 - protein, 190 aa, Homo sapiens
MRLWNKISRWMLGCYDALQKKYLRMVVLAVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVED

SEQ ID NO: 49402 - protein, 323 aa, Homo sapiens
MRLWNKISRWMLGCYDALQKKYLKIMELTVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 49403 - protein, 394 aa, Homo sapiens
MATAQLQRTPMSALVFPNKISTEHQSLVLVKRLLAVSVSCITYLRGIFPECAYGTRYLDDLCVKILREDKNCPGSTQLVKWMLGCYDALQKKYLKIMELTVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 49404 - protein, 314 aa, Homo sapiens
MRLWNKISRWMLGCYDALQKKYLRMVVLATISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 49405 - protein, 164 aa, Homo sapiens
MRLWNKISRWMLGCYDALQKKYVYTNPEDPQTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILS

SEQ ID NO: 49406 - protein, 314 aa, Homo sapiens
MRLWNKISRWMLGCYDALQKKYLRYFLFKTISECYQFKFKYTNNGPLMDFISKNQSNESSMLSTDTKKASILLIRKIYILMQNLGPLPNDVCLTMKLFYYDEVTPPDYQPPGFKDGDCEGVIFEGEPMYLNVGEVSTPFHIFKVKVTTERERMENIDSTILSPKQIKTPFQKILRDKDVEDEQEHYTSDDLDIETKMEEQEKNPASSELEEPSLVCEEDEIMRSKESPDLSISHSQVEQLVNKTSELDMSESKTRSGKVFQNKMANGNQPVKSSKENRKRSQHESGRIVLHHFDSSSQESVPKRRKFSEPKEHI

SEQ ID NO: 49407 - protein, 2035 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 49408 - protein, 1966 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 49409 - protein, 2080 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPKISSMTETAPRALTTEVPIPAKITVTIANTETSDMPFSAVDILQPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMAGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 49410 - protein, 792 aa, Homo sapiens
MAAPSLLNWRRVSSFTGPVPRARHGHRAVAIRELMIIFGGGNEGIADELHVYNTATNQWFLPAVRGDIPPGCAAHGFVCDGTRILVFGGMVEYGRYSNELYELQASRWLWKKVKPHPPPSGLPPCPRLGHSFSLYGNKCYLFGGLANESEDSNNNVPRYLNDFYELELQHGSGVVGWSIPVTKGVVPSPRESHTAVIYCKKDSGSPKMYVFGGMCGARLDDLWQLDLETMSWSKPETKGTVPLPRSLHTASVIGNKMYIFGGWVPHKGENTETSPHDCEWRCTSSFSYLNLDTTEWTTLVSDSQEDKKNSRPRPRAGHCAVAIGTRLYFWSGRDGYKKALNSQVCCKDLWYLDTEKPPAPSQVQLIKATTNSFHVKWDEVSTVEGYLLQLSTDLPYQAASSDSSAAPNMQGVRMDPHRQGSNNIVPNSINDTINSTKTEQPATKETSMKNKPDFKALTDSNAILYPSLASNASNHNSHVVDMLRKNEGPHTSANVGVLSSCLDVRTVIPETSVSSTVSSTQTMVTQQTIKTESSSTNGAVVKDETSLTTFSTKSEVDETYALPATKISRVETHATATPFSKETPSNPVATVKAGERQWCDVGIFKNNTALVSQFYLLPKGKQSISKVGNADVPDYSLLKKQDLVPGTGYRFRVAAINGCGIGPFSKISEFKTCIPGFPGAPSAVRISKNVEGIHLSWEPPTSPSGNILEYSAYLAIRTAQIQDNPSQLVFMRIYCGLKTSCIVTAGQLANAHIDYTSRPAIVFRISAKNEKGYGPATQVRWLQGNNKKAPLN

SEQ ID NO: 49411 - protein, 168 aa, Homo sapiens
MAFNDCFSLNYPGNPCPGDLIEVFRPGYQHWALYLGDGYVINIAPVDGIPASFTSAKSVFSSKALVKMQLLKDVVGNDTYRINNKYDETYPPLPVEEIIKRSEFVIGQEVAYNLLVNNCEHFVTLLRYGEGVSEQANRAISTVEFVTAAVGVFSFLGLFPKGQRAKYY

SEQ ID NO: 49412 - protein, 162 aa, Homo sapiens
MALARPRPRLGDLIEISRFGYAHWAIYVGDGYVVHLAPASEIAGAGAASVLSALTNKAIVKKELLSVVAGGDNYRVNNKHDDRYTPLPSNKIVKRAEELVGQELPYSLTSDNCEHFVNHLRYGVSRSDQVTGAVTTVGVAAGLLAAASLVGILLARSKRERQ

SEQ ID NO: 49413 - protein, 235 aa, Homo sapiens
MWRGRAGALLRVWGFWPTGVPRRRPLSCDAASQAGSNYPRCWNCGGPWGPGREDRFFCPQCRALQAPDPTRDYFSLMDCNRSFRVDTAKLQHRYQQLQRLVHPDFFSQRSQTEKDFSEKHSTLVNDAYKTLLAPLSRGLYLLKLHGIEIPERTDYEMDRQFLIEIMEINEKLAEAESEAAMKEIESIVKAKQKEFTDNVSSAFEQDDFEEAKEILTKMRYFSNIEEKIKLKKIPL

SEQ ID NO: 49414 - protein, 359 aa, Homo sapiens
MSDEGSRGSRLPLALPPASQGCSSGGGGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNAADFCQLSGMHLLVGRYLEAGAAGLRWRAAQLIGTCSQNVAAIQEQVLGLGALRKLLRLLDRDACDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCSLVTDFPQGVRECREPELGLEELLRHRCQLLQQHEEYQEELEFCEKLLQTCFSSPADDSMDR

SEQ ID NO: 49415 - protein, 257 aa, Homo sapiens
MSDEGSRGSRLPLALPPASQGCSSGGGGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNAADFCQLSGMHLLVGRYLEAGAAGLRWRAAQLIGTCSQNVAAIQEQVLGLGALRKLLRLLDRDACDTGVRECREPELGLEELLRHRCQLLQQHEEYQEELEFCEKLLQTCFSSPADDSMDR

SEQ ID NO: 49416 - protein, 359 aa, Homo sapiens; identical to SEQ ID NO: 49414

SEQ ID NO: 49417 - protein, 480 aa, Homo sapiens
MQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 49418 - protein, 221 aa, Homo sapiens
GKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 49419 - protein, 447 aa, Homo sapiens
MGWAARPRALAPAAPEALLHSPRRRSPALALSAATAAAARGPGRVRLLRGVRRARGRRVRPAGGPVRRGAAVRGALRGASLGHGAAARAGRPLCVRQQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 49420 - protein, 458 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 49421 - protein, 361 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKFGNSGGPLVNLDGEVIGVNTMKVTAGISFAIPSDRLREFLHRGEKKNSSSGISGSQRRYIGVMMLTLSPRAGLRPGDVILAIGEQMVQNAEDVYEAVRTQSQLAVQIRRGRETLTLYVTPEVTE

SEQ ID NO: 49422 - protein, 453 aa, Homo sapiens
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRPGEFVVAIGSPFALQNTVTTGIVSTAQREGRELGLRDSDMDYIQTDAIINYGNSGGPLVNLDGEVIGINTLKVTAGISFAIPSDRITRFLTEFQDKQIKDWKKRFIGIRMRTITPSLVDELKASNPDFPEVSSGIYVQEVAPNSPSQRGGIQDGDIIVKVNGRPLVDSSELQEAVLTESPLLLEVRRGNDDLLFSIAPEVVM

SEQ ID NO: 49423 - protein, 476 aa, Homo sapiens
MIRPQLRTAGLGRCLLPGLLLLLVPVLWAGAEKLHTQPSCPAVCQPTRCPALPTCALGTTPVFDLCRCCRVCPAAEREVCGGAQGQPCAPGLQCLQPLRPGFPSTCGCPTLGGAVCGSDRRTYPSMCALRAENRAARRLGKVPAVPVQWGNCGDTGTRSAGPLRRNYNFIAAVVEKVAPSVVHVQLWGRLLHGSRLVPVYSGSGFIVSEDGLIITNAHVVRNQQWIEVVLQNGARYEAVVKDIDLKLDLAVIKIESNAELPVLMLGRSSDLRAGEFVVALGSPFSLQNTATAGIVSTKQRGGKELGMKDSDMDYVQIDATINYGNSGGPLVNLDGDVIGVNSLRVTDGISFAIPSDRVRQFLAEYHEHQMKGKAFSNKKYLGLQMLSLTVPLSEELKMHYPDFPDVSSGVYVCKVVEGTAAQSSGLRDHDVIVNINGKPITTTTDVVKALDSDSLSMAVLRGKDNLLLTVIPETIN

SEQ ID NO: 49424 - protein, 2718 aa, Homo sapiens
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSELRRWRSEGADPAKFSDLDEQCDSSSLSSKTRTDNSECISSHCGTTSPSYTNTAFDVLLKAMEPELSTLSQKGSPCAIKTEKLRPNKTARSPPKLKNSSMDAPNQTSQELVAESQSSCTSYTVHMSAAQKNEQGAMQSASHLYHQHEHFVPKSNQHNQQLPGCSGFTGSLTNLQNQENAKLEQVYNIAVTSSVGLTSPSSRSQVTPQNQQMDSASPLSISPANSTQSPPMPIYNSTHVASVVNQSVEQMCNLLLKDQKPKKQGKYICEYCNRACAKPSVLLKHIRSHTGERPYPCVTCGFSFKTKSNLYKHKKSHAHTIKLGLVLQPDAGGLFLSHESPKALSIHSDVEDSGESEEEGATDERQHDLGAMELQPVHIIKRMSNAETLLKSSFTPSSPENVIGDFLLQDRSAESQAVTELPKVVVHHVTVSPLRTDSPKAMDPKPELSSAQKQKDLQVTNVQPLSANMSQGGVSRLETNENSHQKGDMNPLEGKQDSHVGTVHAQLQRQQATDYSQEQQGKLLSPRSLGSTDSGYFSRSESADQTVSPPTPFARRLPSTEQDSGRSNGPSAALVTTSTPSALPTGEKALLLPGQMRPPLATKTLEERISKLISDNEALVDDKQLDSVKPRRTSLSRRGSIDSPKSYIFKDSFQFDLKPVGRRTSSSSDIPKSPFTPTEKSKQVFLLSVPSLDCLPITRSNSMPTTGYSAVPANIIPPPHPLRGSQSFDDKIGTFYDDVFVSGPNAPVPQSGHPRTLVRQAAIEDSSANESHVLGTGQSLDESHQGCHAAGEAMSVRSKALAQGPHIEKKKSHQGRGTMFECETCRNRYRKLENFENHKKFYCSELHGPKTKVAMREPEHSPVPGGLQPQILHYRVAGSSGIWEQTPQIRKRRKMKSVGDDEELQQNESGTSPKSSEGLQFQNALGCNPSLPKHNVTIRSDQQHKNIQLQNSHIHLVARGPEQTMDPKLSTIMEQQISSAAQDKIELQRHGTGISVIQHTNSLSRPNSFDKPEPFERASPVSFQELNRTGKSGSLKVIGISQEESHPSRDGSHPHQLALSDALRGELQESSRKSPSERHVLGQPSRLVRQHNIQVPEILVTEEPDRDLEAQCHDQEKSEKFSWPQRSETLSKLPTEKLPPKKKRLRLAEIEHSSTESSFDSTLSRSLSRESSLSHTSSFSASLDIEDVSKTEASPKIDFLNKAEFLMIPAGLNTLNVPGCHREMRRTASEQINCTQTSMEVSDLRSKSFDCGSITPPQTTPLTELQPPSSPSRVGVTGHVPLLERRRGPLVRQISLNIAPDSHLSPVHPTSFQNTALPSVNAVPYQGPQLTSTSLAEFSANTLHSQTQVKDLQAETSNSSSTNVFPVQQLCDINLLNQIHAPPSHQSTQLSLQVSTQGSKPDKNSVLSGSSKSEDCFAPKYQLHCQVFTSGPSCSSNPVHSLPNQVISDPVGTDHCVTSATLPTKLIDSMSNSHPLLPPELRPLGSQVQKVPSSFMLPIRLQSSVPAYCFATLTSLPQILVTQDLPNQPICQTNHSVVPISEEQNSVPTLQKGHQNALPNPEKEFLCENVFSEMSQNSSLSESLPITQKISVGRLSPQQESSASSKRMLSPANSLDIAMEKHQKRAKDENGAVCATDVRPLEALSSRVNEASKQKKPILVRQVCTTEPLDGVMLEKDVFSQPEISNEAVNLTNVLPADNSSTGCSKFVVIEPISELQEFENIKSSTSLTLTVRSSPAPSENTHISPLKCTDNNQERKSPGVKNQGDKVNIQEQSQQPVTSLSLFNIKDTQQLAFPSLKTTTNFTWCYLLRQKSLHLPQKDQKTSAYTDWTVSASNPNPLGLPTKVALALLNSKQNTGKSLYCQAITTHSKSDLLVYSSKWKSSLSKRALGNQKSTVVEFSNKDASEINSEQDKENSLIKSEPRRIKIFDGGYKSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 49425 - protein, 128 aa, Homo sapiens
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEES

SEQ ID NO: 49426 - protein, 142 aa, Homo sapiens
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSE

SEQ ID NO: 49427 - protein, 120 aa, Homo sapiens
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIA

SEQ ID NO: 49428 - protein, 583 aa, Homo sapiens
MLKKHIRTHTDVRPYHCTYCNFSFKTKDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 49429 - protein, 700 aa, Homo sapiens
GDKFSFQRALGNQKSTVVEFSNKDASEINSEQDKENSLIKSEPRRIKIFDGGYKSNEEYVYVRGRGRGKYICEECGIRCKKPSMLKKHIRTHTDVRPYHCTYCNFSFKTKGNLTKHMKSKAHSKKCVDLGVSVGLIDEQDTEESDEKQRFSYERSGYDLEESDGPDEDDNENEDDDEDSQAESVLSATPSVTASPQHLPSRSSLQDPVSTDEDVRITDCFSGVHTDPMDVLPRALLTRMTVLSTAQSDYNRKTLSPGKARQRAARDENDTIPSVDTSRSPCHQMSVDYPESEEILRSSMAGKAVAITQSPSSVRLPPAAAEHSPQTAAGMPSVASPHPDPQEQKQQITLQPTPGLPSPHTHLFSHLPLHSQQQSRTPYNMVPVGGIHVVPAGLTYSTFVPLQAGPVQLTIPAVSVVHRTLGTHRNTVTEVSGTTNPAGVAELSSVVPCIPIGQIRVPGLQNLSTPGLQSLPSLSMETVNIVGLANTNMAPQVHPPGLALNAVGLQVLTANPSSQSSPAPQAHIPGLQILNIALPTLIPSVSQVAVDAQGAPEMPASQSKACETQPKQTSVASANQVSRTESPQGLPTVQRENAKKVLNPPAPAGDHARLDGLSKMDTEKAASANHVKPKPELTSIQGQPASTSQPLLKAHSEVFTKPSGQQTLSPDRQVPRPTALPRRQPTVHFSDVSSDDDEDRLVIAT

SEQ ID NO: 49430 - protein, 2446 aa, Homo sapiens
MDTGDTALGQKATSRSGETDKASGRWRQEQSAVIKMSTFGSHEGQRQPQIEPEQIGNTASAQLFGSGKLASPSEVVQQVAEKQYPPHRPSPYSCQHSLSFPQHSLPQGVMHSTKPHQSLEGPPWLFPGPLPSVASEDLFPFPIHGHSGGYPRKKISSLNPAYSQYSQKSIEQAEEAHKKEHKPKKPGKYICPYCSRACAKPSVLKKHIRSHTGERPYPCIPCGFSFKTKSNLYKHRKSHAHAIKAGLVPFTESAVSKLDLEAGFIDVEAEIHSDGEQSTDTDEESSLFAEASDKMSPGPPIPLDIASRGGYHGSLEESLGGPMKVPILIIPKSGIPLPNESSQYIGPDMLPNPSLNTKADDSHTVKQKLALRLSEKKGQDSEPSLNLLSPHSKGSTDSGYFSRSESAEQQISPPNTNAKSYEEIIFGKYCRLSPRNALSVTTTSQERAAMGRKGIMEPLPHVNTRLDVKMFEDPVSQLIPSKGDVDPSQTSMLKSTKFNSESRQPQIIPSSIRNEGKLYPANFQGSNPVLLEAPVDSSPLIRSNSVPTSSATNLTIPPSLRGSHSFDERMTGSDDVFYPGTVGIPPQRMLRRQAAFELPSVQEGHVEVEHHGRMLKGISSSSLKEKKLSPGDRVGYDYDVCRKPYKKWEDSETPKQNYRDISCLSSLKHGGEYFMDPVVPLQGVPSMFGTTCENRKRRKEKSVGDEEDTPMICSSIVSTPVGIMASDYDPKLQMQEGVRSGFAMAGHENLSHGHTERFDPCRPQLQPGSPSLVSEESPSAIDSDKMSDLGGRKPPGNVISVIQHTNSLSRPNSFERSESAELVACTQDKAPSPSETCDSEISEAPVSPEWAPPGDGAESGGKPSPSQQVQQQSYHTQPRLVRQHNIQVPEIRVTEEPDKPEKEKEAQSKEPEKPVEEFQWPQRSETLSQLPAEKLPPKKKRLRLADMEHSSGESSFESTGTGLSRSPSQESNLSHSSSFSMSFEREETSKLSALPKQDEFGKHSEFLTVPAGSYSLSVPGHHHQKEMRRCSSEQMPCPHPAEVPEVRSKSFDYGNLSHAPVSGAAASTVSPSRERKKCFLVRQASFSGSPEISQGEVGMDQSVKQEQLEHLHAGLRSGWHHGPPAVLPPLQQEDPGKQVAGPCPPLSSGPLHLAQPQIMHMDSQESLRNPLIQPTSYMTSKHLPEQPHLFPHQETIPFSPIQNALFQFQYPTVCMVHLPAQQPPWWQAHFPHPFAQHPQKSYGKPSFQTEIHSSYPLEHVAEHTGKKPAEYAHTKEQTYPCYSGASGLHPKNLLPKFPSDQSSKSTETPSEQVLQEDFASANAGSLQSLPGTVVPVRIQTHVPSYGSVMYTSISQILGQNSPAIVICKVDENMTQRTLVTNAAMQGIGFNIAQVLGQHAGLEKYPIWKAPQTLPLGLESSIPLCLPSTSDSVATLGGSKRMLSPASSLELFMETKQQKRVKEEKMYGQIVEELSAVELTNSDIKKDLSRPQKPQLVRQGCASEPKDGLQSGSSSFSSLSPSSSQDYPSVSPSSREPFLPSKEMLSGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQMKPDASFLFGSKLERKLVGNILKERGKGDIHGDKDIGSKQTEPIRIKIFEGGYKSNEDYVYVRGRGRGKYICEECGIRCKKPSMLKKHIRTHTDVRPYVCKLCNFAFKTKGNLTKHMKSKAHMKKCLELGVSMTSVDDTETEEAENLEDLHKAAEKHSMSSISTDHQFSDAEESDGEDGDDNDDDDEDEDDFDDQGDLTPKTRSRSTSPQPPRFSSLPVNVGAVPHGVPSDSSLGHSSLISYLVTLPSIRVTQLMTPSDSCEDTQMTEYQRLFQSKSTDSEPDKDRLDIPSCMDEECMLPSEPSSSPRDFSPSSHHSSPGYDSSPCRDNSPKRYLIPKGDLSPRRHLSPRRDLSPMRHLSPRKEAALRREMSQRDVSPRRHLSPRRPVSPGKDITARRDLSPRRERRYMTTIRAPSPRRALYHNPPLSMGQYLQAEPIVLGPPNLRRGLPQVPYFSLYGDQEGAYEHPGSSLFPEGPNDYVFSHLPLHSQQQVRAPIPMVPVGGIQMVHSMPPALSSLHPSPTLPLPMEGFEEKKGASGESFSKDPYVLSKQHEKRGPHALQSSGPPSTPSSPRLLMKQSTSEDSLNATEREQEENIQTCTKAIASLRIATEEAALLGPDQPARVQEPHQNPLGSAHVSIRHFSRPEPGQPCTSATHPDLHDGEKDNFGTSQTPLAHSTFYSKSCVDDKQLDFHSSKELSSSTEESKDPSSEKSQLH

SEQ ID NO: 49431 - protein, 2446 aa, Homo sapiens; identical to SEQ ID NO: 49430

SEQ ID NO: 49432 - protein, 2446 aa, Homo sapiens; identical to SEQ ID NO: 49430

SEQ ID NO: 49433 - protein, 2406 aa, Homo sapiens
MDPEQSVKGTKKAEGSPRKRLTKGEAIQTSVSSSVPYPGSGTAATQESPAQELLAPQPFPGPSSVLREGSQEKTGQQQKPPKRPPIEASVHISQLPQHPLTPAFMSPGKPEHLLEGSTWQLVDPMRPGPSGSFVAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSHSSHVFTSHPRMLKRQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPARVAPPERRKCFLVRQASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGYKSNEEYVYVRGRGRGKYVCEECGIRCKKPSMLKKHIRTHTDVRPYVCKHCHFAFKTKGNLTKHMKSKAHSKKCQETGVLEELEAEEGTSDDLFQDSEGREGSEAVEEHQFSDLEDSDSDSDLDEDEDEDEEESQDELSRPSSEAPPPGPPHALRADSSPILGPQPPDAPASGTEATRGSSVSEAERLTASSCSMSSQSMPGLPWLGPAPLGSVEKDTGSALSYKPVSPRRPWSPSKEAGSRPPLARKHSLTKNDSSPQRCSPAREPQASAPSPPGLHVDPGRGMGALPCGSPRLQLSPLTLCPLGRELAPRAHVLSKLEGTTDPGLPRYSPTRRWSPGQAESPPRSAPPGKWALAGPGSPSAGEHGPGLGLDPRVLFPPAPLPHKLLSRSPETCASPWQKAESRSPSCSPGPAHPLSSRPFSALHDFHGHILARTEENIFSHLPLHSQHLTRAPCPLIPIGGIQMVQARPGAHPTLLPGPTAAWVSGFSGGGSDLTGAREAQERGRWSPTESSSASVSPVAKVSKFTLSSELEGGDYPKERERTGGGPGRPPDWTPHGTGAPAEPTPTHSPCTPPDTLPRPPQGRRAAQSWSPRLESPRAPTNPEPSATPPLDRSSSVGCLAEASARFPARTRNLSGEPRTRQDSPKPSGSGEPRAHPHQPEDRVPPNA

SEQ ID NO: 49434 - protein, 2406 aa, Homo sapiens; identical to SEQ ID NO: 49433

SEQ ID NO: 49435 - protein, 2405 aa, Homo sapiens
MDPEQSVKGTKKAEGSPRKRLTKGEAIQTSVSSSVPYPGSGTAATQESPAQELLAPQPFPGPSSVLREGSQEKTGQQQKPPKRPPIEASVHISQLPQHPLTPAFMSPGKPEHLLEGSTWQLVDPMRPGPSGSFVAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSHSSHVFTSHPRMLKRQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPARVAPPERRKCFLVRQASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGYKSNEEYVYVRGRGRGKYVCEECGIRCKKPSMLKKHIRTHTDVRPYVCKHCHFAFKTKGNLTKHMKSKAHSKKCQETGVLEELEAEEGTSDDLFQDSEGREGSEAVEEHQFSDLEDSDSDSDLDEDEDEDEEESQDELSRPSSEAPPPGPPHALRADSSPILGPQPPDAPASGTEATRGSSVSEAERLTASSCSMSSQSMPGLPWLGPAPLGSVEKDTGSALSYKPVSPRRPWSPSKEAGSRPPLARKHSLTKNDSSPQRCSPAREPQASAPSPPGLHVDPGRGMGALPCGSPRLQLSPLTLCPLGRELAPRAHVLSKLEGTTDPGLPRYSPTRRWSPGQAESPPRSAPPGKWALAGPGSPSAGEHGPGLGLDPRVLFPPAPLPHKLLSRSPETCASPWKAESRSPSCSPGPAHPLSSRPFSALHDFHGHILARTEENIFSHLPLHSQHLTRAPCPLIPIGGIQMVQARPGAHPTLLPGPTAAWVSGFSGGGSDLTGAREAQERGRWSPTESSSASVSPVAKVSKFTLSSELEGGDYPKERERTGGGPGRPPDWTPHGTGAPAEPTPTHSPCTPPDTLPRPPQGRRAAQSWSPRLESPRAPTNPEPSATPPLDRSSSVGCLAEASARFPARTRNLSGEPRTRQDSPKPSGSGEPRAHPHQPEDRVPPNA

SEQ ID NO: 49436 - protein, 2405 aa, Homo sapiens; identical to SEQ ID NO: 49435

SEQ ID NO: 49437 - protein, 3142 aa, Homo sapiens
MATLEKLMKAFESLKSFQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 49438 - protein, 1037 aa, Homo sapiens
MDRMASSMKQVPNPLPKVLSRRGVGAGLEAAERESFERTQTVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEEMLSKSRAGDTGVKLEVNERILGCCTSLMQAIQVLIVASKDLQREIVESGRGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 49439 - protein, 986 aa, Homo sapiens
MDRMASSMKQVPNPLPKVLSRRGVGAGLEAAERESFERTQTVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 49440 - protein, 1068 aa, Homo sapiens
MNSIKNVPARVLSRRPGHSLEAEREQFDKTQAISISKAINTQEAPVKEKHARRIILGTHHEKGAFTFWSYAIGLPLPSSSILSWKFCHVLHKVLRDGHPNVLHDCQRYRSNIREIGDLWGHLHDRYGQLVNVYTKLLLTKISFHLKHPQFPAGLEVTDEVLEKAAGTDVNNIFQLTVEMFDYMDCELKLSESVFRQLNTAIAVSQMSSGQCRLAPLIQVIQDCSHLYHYTVKLLFKLHSCLPADTLQGHRDRFHEQFHSLRNFFRRASDMLYFKRLIQIPRLPEGPPNFLRASALAEHIKPVVVIPEEAPEDEEPENLIEISTGPPAGEPVVVADLFDQTFGPPNGSVKDDRDLQIESLKREVEMLRSELEKIKLEAQRYIAQLKSQVNALEGELEEQRKQKQKALVDNEQLRHELAQLRAAQLEGERSQGLREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERESQEQGLRQRLLDEQFAVLRGAAAEAAGILQDAVSKLDDPLHLRCTSSPDYLVSRAQEALDAVSTLEEGHAQYLTSLADASALVAALTRFSHLAADTIINGGATSHLAPTDPADRLIDTCRECGARALELMGQLQDQQALRHMQASLVRTPLQGILQLGQELKPKSLDVRQEELGAVVDKEMAATSAAIEDAVRRIEDMMNQARHASSGVKLEVNERILNSCTDLMKAIRLLVTTSTSLQKEIVESGRGAATQQEFYAKNSRWTEGLISASKAVGWGATQLVEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 49441 - protein, 250 aa, Homo sapiens
MAHVGTSRVGSVLSMSLSIHLLVPTMTKGETGKPGHHEAPRTLQAFPWTWARASPGVSVDMSAGLPQSLLCWPGAPLLPTPPLPSATYVGHSLGLPRAGSSVGPWFSGRWVGGALVQWPLGGGGPGSVAAGLGGPLVRWLLGGGALVRWPLGGGGPGSVAAGWGGPWFGGRWVGGPPGSVAAGWGGPVRWPLGGGGPGSVATGWGGPWFGGRWVGGPPGSVAAGCGGALVQWPLGGGSLHSIPSFPRAWR

SEQ ID NO: 49442 - protein, 671 aa, Homo sapiens
MRPKRLGRCCAGSRLGPGDPAALTCAPSPSASPAPEPSAQPQARGTGQRVGSRATSGSQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEELLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMYGAETEKLQKQLASEKEIQMQLQEESVWVGSQLQDLREKYMDCGGMLIEMQEEVKTLRQQPPVSTGSATHYPYSVPLETLPGFQETLAEELRTSLRRMISDPVYFMERNYEMPRGDTSSLRYDFRYSEDREQVRGFEAEEGLMLAADIMRGEDFTPAEEFVPQEELGAAKKVPAEEGVMEEAELVSEETEGWEEVELELDEATRMNVVTSALEASGLGPSHLDMNYVLQQLANWQDAHYRRQLRWKMLQKGECPHGALPAASRTSCRSSCR

SEQ ID NO: 49443 - protein, 602 aa, Homo sapiens
MRPKRLGRCCAGSRLGPGDPAALTCAPSPSASPAPEPSAQPQARGTGQRVGSRATSGSQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEEVCTAFLIQLLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMETLPGFQETLAEELRTSLRRMISDPVYFMERNYEMPRGDTSSLRYDFRYSEDREQVRGFEAEEGLMLAADIMRGEDFTPAEEFVPQEELGAAKKVPAEEGVMEEAELVSEETEGWEEVELELDEATRMNVVTSALEASGLGPSHLDMNYVLQQLANWQDAHYRRQLRWKMLQKGECPHGALPAASRTSCRSSCR

SEQ ID NO: 49444 - protein, 619 aa, Homo sapiens
MRPKRLGRCCAGSRLGPGDPAALTCAPSPSASPAPEPSAQPQARGTGQRVGSRATSGSQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEELLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMYGAETEKLQKQLASEKEIQMQLQEEETLPGFQETLAEELRTSLRRMISDPVYFMERNYEMPRGDTSSLRYDFRYSEDREQVRGFEAEEGLMLAADIMRGEDFTPAEEFVPQEELGAAKKVPAEEGVMEEAELVSEETEGWEEVELELDEATRMNVVTSALEASGLGPSHLDMNYVLQQLANWQDAHYRRQLRWKMLQKGECPHGALPAASRTSCRSSCR

SEQ ID NO: 49445 - protein, 594 aa, Homo sapiens
MRPKRLGRCCAGSRLGPGDPAALTCAPSPSASPAPEPSAQPQARGTGQRVGSRATSGSQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEELLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMETLPGFQETLAEELRTSLRRMISDPVYFMERNYEMPRGDTSSLRYDFRYSEDREQVRGFEAEEGLMLAADIMRGEDFTPAEEFVPQEELGAAKKVPAEEGVMEEAELVSEETEGWEEVELELDEATRMNVVTSALEASGLGPSHLDMNYVLQQLANWQDAHYRRQLRWKMLQKGECPHGALPAASRTSCRSSCR

SEQ ID NO: 49446 - protein, 278 aa, Homo sapiens
MKFRAKITGKGCLELFIHVSGTVARLAKVCVLRVRPDSLCFGPAGSGGLHEARLWCEVRQGAFQQFRMEGVSEDLDEIHLELTAEHLSRAARSAAGASSLKLQLTHKRRPSLTVAVELVSSLGRARSVVHDLPVRVLPRRVWRDCLPPSLRASDASIRLPRWRTLRSIVERMANVGSHVLVEANLSGRMTLSIETEVVSIQSYFKNLGNPPQSAVGVPENRDLESMVQVRVDNRKLLQFLEGQQIHPTTALCNIWDNTLLQLVLVQEDVSLQYFIPAL

SEQ ID NO: 49447 - protein, 354 aa, Homo sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKILGYDRCDAGWLADGSVRYPISRPRRRCSPTEAAVRFVGFPDKKHKLYGVYCFRAYN

SEQ ID NO: 49448 - protein, 182 aa, Homo sapiens
MKSLLLLVLISICWADHLSDNYTLDHDRAIHIQENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLD

SEQ ID NO: 49449 - protein, 158 aa, Homo sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQG

SEQ ID NO: 49450 - protein, 199 aa, Homo sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWR

SEQ ID NO: 49451 - protein, 258 aa, Homo sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFN

SEQ ID NO: 49452 - protein, 153 aa, Homo sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVA

SEQ ID NO: 49453 - protein, 560 aa, Homo sapiens
MFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 49454 - protein, 177 aa, Homo sapiens
MEENFICSRKTMALSSTWILSPKKTGPLTSMITATRIIIRKRTPVAHLPTLRILTGTTLRTKLIHASPTPVNTVGTASSMGAPSHAAAWLLSLGISVRKCKIRARTTHVAGANVSLPRVLPTTAVSVNTLTQVPAAPKWFLYAGQTPARMGLPAPGISGDPSSPVPVPTSSRGNSVK

SEQ ID NO: 49455 - protein, 280 aa, Homo sapiens
MFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQA

SEQ ID NO: 49456 - protein, 534 aa, Homo sapiens
MSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 49457 - protein, 578 aa, Homo sapiens
MRQQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 49458 - protein, 185 aa, Homo sapiens
MFREVFADEDPATYVWDGNYHQPWEPAAAGAVGAGAYREVEAEDPGRLAVEALVRTRRCVCVAQRWGGKREVMYTAFKALGDSVDYVQFCRVCDSDTRLDPMALLELVRVLDEDPRVGAVGGDVRILNPLDSWVSFLSSLRYWVAFNVERACQSYFHCVSCISGPLGTPPGPAATQRRPRPSCGG

SEQ ID NO: 49459 - protein, 214 aa, Homo sapiens
MFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLESCPGPREHAMMPSFLAPVQVHLQVPLLLRDALVLPAVAEPADTLVQVVLP

SEQ ID NO: 49460 - protein, 577 aa, Homo sapiens
MRQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 49461 - protein, 552 aa, Homo sapiens
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 49462 - protein, 316 aa, Homo sapiens
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHVLTFAVTHNTLVPLGAVQYCGIR

SEQ ID NO: 49463 - protein, 281 aa, Homo sapiens
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQPPGKGMAVEDDQVQAAQVRATEAWSVHQRHVSREQ

SEQ ID NO: 49464 - protein, 553 aa, Homo sapiens
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQILNKYDSWISFLSSVRYWMAFNVERACQSYFGCVQCISGPLGMYRNSLLQQFLEDWYHQKFLGSKCSFGDDRHLTNRVLSLGYRTKYTARSKCLTETPTKYLRWLNQQTRWSKSYFREWLYNSLWFHKHHLWMTYESVVTGFFPFFLIATVIQLFYRGRIWNILLFLLTVQLVGIIKATYACFLRGNAEMIFMSLYSLLYMSSLLPAKIFAIATINKSGWGTSGRKTIVVNFIGLIPVSIWVAVLLGGLAYTAYCQDLFSETELAFLVSGAILYGCYWVALLMLYLAIIARRCGKKPEQYSLAFAEV

SEQ ID NO: 49465 - protein, 435 aa, Homo sapiens
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 49466 - protein, 435 aa, Homo sapiens; identical to SEQ ID NO: 49465

SEQ ID NO: 49467 - protein, 405 aa, Homo sapiens
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 49468 - protein, 435 aa, Homo sapiens; identical to SEQ ID NO: 49465

SEQ ID NO: 49469 - protein, 103 aa, Homo sapiens
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLI

SEQ ID NO: 49470 - protein, 176 aa, Homo sapiens
MYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 49471 - protein, 69 aa, Homo sapiens
MAAHLLPICALFLTLLDMAQGFRGPLLPNRPFTTVWNANTQWCLERHGVDVDVSVFDVVANPGQTFRGP

SEQ ID NO: 49472 - protein, 253 aa, Homo sapiens
MAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 49473 - protein, 473 aa, Homo sapiens
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 49474 - protein, 473 aa, Homo sapiens; identical to SEQ ID NO: 49473

SEQ ID NO: 49475 - protein, 48 aa, Homo sapiens
MRAGPGPTVTLALVLAVSWAMELKPTAPPIFTGRPFVVAWDVPTQDCG

SEQ ID NO: 49476 - protein, 117 aa, Homo sapiens
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRV

SEQ ID NO: 49477 - protein, 81 aa, Homo sapiens
MRAGPGPTVTLALVLAVSWAMELKPTAPPIFTGRPFVVAWDVPTQDCGPRLKVPLDLNAFDVQASPNEGFVNQNITIFYRD

SEQ ID NO: 49478 - protein, 76 aa, Homo sapiens
MRAGPGPTVTLALVLAVSWAMELKPTAPPIFTGRPFVVAWDVPTQDCGPRLKVPLDLNAFDVQASPNEGFVNQNIT

SEQ ID NO: 49479 - protein, 473 aa, Homo sapiens; identical to SEQ ID NO: 49473

SEQ ID NO: 49480 - protein, 473 aa, Homo sapiens; identical to SEQ ID NO: 49473

SEQ ID NO: 49481 - protein, 121 aa, Homo sapiens
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYI

SEQ ID NO: 49482 - protein, 417 aa, Homo sapiens
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 49483 - protein, 387 aa, Homo sapiens
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 49484 - protein, 168 aa, Homo sapiens
MLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 49485 - protein, 160 aa, Homo sapiens
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDL

SEQ ID NO: 49486 - protein, 387 aa, Homo sapiens; identical to SEQ ID NO: 49483

SEQ ID NO: 49487 - protein, 138 aa, Homo sapiens
MLPPAHHQAFVRHRLEEAFRVALVGHRHPLPVLAYVRLTHRRSGRFLSQEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 49488 - protein, 481 aa, Homo sapiens
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 49489 - protein, 481 aa, Homo sapiens; identical to SEQ ID NO: 49488

SEQ ID NO: 49490 - protein, 45 aa, Homo sapiens
MKVLSEGQLKLCVVQPVHLTSWLLIFFILKSISCLKPARLPIYQR

SEQ ID NO: 49491 - protein, 63 aa, Homo sapiens
MKVLSEGQLKLCVVQPVHLTSWLLIFFILKSISCLKPARLPIYQRKPFIAAWNAPTDQCLIKY

SEQ ID NO: 49492 - protein, 5121 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRIVKEKLVCHAIIGAQKGKSLVMAVNITCEFVAPLIQLSTKQLIYRLEKKPNSILKPDYQPLAIKNISTLPVNLLLSTSGPFFICETDKSLLPATPEPIKLEIDEEKNLLIKFDPSYRNDLNNWVAEEILAIKYVEHPQIDSLDLRGEVHYPNLSFETKELDFGCILNDTELIRYVTITNCSPLVVKFRWFFLVNDEENQIRFVTLPKKPYSAPVSQMESIPATSEAASPPAILVTVESPEMDLNDFVKTVLVDEDARPEEKELRKTKASSVISDEIKISSTEIERIYSSQSQVEDQESLQTCEQNEMLSIGIEEVFDILPLFGVLQPHSSHQISFTFYGHANIIAQAKALCEVEEGPTYEITLKGEASLVNYSFDTKDIHYGLQLFDHVTEREITLTNMGKVGFEFKVLTDHQSSPDNLLPGVPLILPVSGFISSHQEQVLKVYYLPGVPEVFKRSFQIQIAHLDPENITLSGEGIFPQICLDLPRNLTANEKYEMFLNQARKNTDKEYNKCEMLDHFDIITEEVPEDEPAEVSAHLQMEVERLIVQSYVLEHQKTTTPDPMDDPCFSHRSRRKLAKIQLPEYILDFGYIILGEVRTHIIKIINTSHFPVSFHADKRVLHETGFSTELDRVKNLPHCETEIFEVRFDPQGANLPVGSKEVILPIKVVGGPTVHICLQAKVTIPTMTLSRGKVDFATIQCGQCLVETIQLSNHLQVPCEWFVQSQKPVDKLEKHMPKYLRQKLRAELKPKTRIFEIQPISGVLDPGEKSNVQVKFMPKEEKFYSQTLVFQIAQSAQKLTLLARGQGLEPRLEFSPSVLDLGPLLLCAPGDEAEVIVKNPCNFPIEFYSLEFDQQYLIEEKILRKLKGYDSYNTLLLPPRNPGEKLPPELYEYFKEIKKSKEEQMRAKYLENLAQENEEEDITSSDQGTSNSTKRTSLSRGISVTSNLEEWHALLVESKTYLEEEEDEESLEKIIFQTDKLQSIDSHSMEEVGEVENNPVSKAIARHLGIDISAEGRLAKNRKGIAIIIHGTPLSGKSANAVSVAKYYNAACLSIDSIVLEAVANSNNIPGIRARELCIRAAIEQSVKEGEEAAQEAAVGQNVIGQGRLSTDTLGKLASEMTLVAPEIKPGKSVRGSVVITKSKADSHGSGSQKQHHSHQSETPQISSSPLPPGPIHRWLSVSPSVGGETGLMSCVLPDELLVQILAERIQLSDCYRGVVFDGLDTLFAQNAAAALLCLLKAIGSREHIYILNMAQDYAAMKAQEKAKKEQEERKHKGALEKEKERLQNMDEEEYDALTEEEKLTFDRGIQQALRERKKREQERLAKEMQEKKLQQELERQKEEDELKRRVKKGKQGPIKEEPPMKKSQAANKQVPPLTKVDVKMETIERKISVREQTMSEKEELNKKKRNMGDVSMHGLPLVQDQEDSEGDNSKDPDKQLAPKFKTYELTLKDVQNILMYWDRKQGVQLPPAGMEEAPHEPDDQRQVPLGGRRGRKDRERERLEKERTEKERLEREKAERERLEKLRALEERSDWEGEGEEDHEGKKEKDLGVPFLDIQTPDFEGLSWKQALESDKLPKGEQILDILGLGASGPPIPPPALFSIVSYPVKRPPLTMTDDLEHFVFVIPPSEDISLDEKKEMEIESDFLATTNTTKAQEEQTSSSKGGKQKMKEKIDQVFEIQKDKRHMALNRKVLSGEPAGTISQLSDTDLDNFNGQHSQEKFTRLNHFRWIVPANGEVTLQVHFSSDEFGNFDQTFNFEILGTCCQYQLYCRGICTYPYICQDPKVVFPQRKMDMKTNEVIFKKYVMSTETYYFGPLLCGKSRDKYKSSLFPGNMETLTILNTSLMVVEASFYFQNDVKANTYFLEPNTMVLKPNEKQILNVWAYPTSVGVFEDSIVCCINDNPEPAIFQLSCQGIRPELELEPRQLHFDRLLLHRQESRVVLLRNVTLLPVAWRITSLEHLGDDFTVSLMQGTIPPEAEYGLHLYFQPTKPVNIKKAIRLEVLDAENLLGVVQIENIMVFAEAYDIALDITFPKGAEGGLDFGIVRVTEEAKQPLQLKNRGKYEIAFSFSVDSVGISTPNINSMISVQPKKGSLTPTEKPTNVQVFFHAKKEVKIEHQPVLRCQIIEPNISEGGEIIASIPIKFSANAVYSKYNITPSSVINFGALICGTRKSTTFTIENQGVTDFKFALYKLTGESPIHQKKAASHVRHARSRESESFYKTGSSRAAKFSDTIQKEVTTTGQARFAHGMFTVYPGFGSIPSGGQQVINVDCVADAMGKCEEFIAIDISGRDPAVHPAGILYTLLAEACLPAFVTENNALIFEEHQICTSANLHHILQTIESGGLFVEDENKFIFCNVLVGRQAKARFKISNVGKITCDVNIVVRPISNKPFARIVDIFEVEPSKMCIASHSHAFATVSFTPQIMQNYQCIFEATLDGLPSTLAKSRGLVFDIAGEGNLPRVTVVRPVLHNQYGNPLLLFKRLLLGHSEKLPLILKNNGVLPAQLHVDLQDELGVFSLKGRPTTAYIYITEENKPHVKAKKAHTASLVVSPGDTAEFDVVFHSQKVGRMRGIIHLSVINNQYEETSIHMVGEGYEDDITLDNIHGLVAPTSQEDISISEFTEIIEDNDMEDLVAAALVDHIQFGDCHIGHSYNASFTVTNHSQVNLIRFEWPVSATIAFSPQMGHLHPGCAKDIVVTMKSDVPINLKNMRIRCKLSRIMFQLPADQVPDWDDRMHTVKWVDVPRNMPGTFTTKRKVIETDPEPAHSVLEENYQELQLQISANVDFASYHCQARDVRFKETLVYQTRVFEFDVINSGRVQLEFSWVSEDTSKAVSFAKPDHQGSAQKDQLSQGTMHTGSTLDSTMDHWAEGSPQPFSVEPSSGIVPVGKIQKFKVKFSPLDIGDFESNLFCQIPNLPPGEQGPVLVAKGRSTLPICHFDLKDSDYISGHQRNPELRGSSGGALDPNTRVIEFTTVGIGGKNLRTFTILNPTNSTYSFCWISEEIESLQNPAAFTCLTEKGFIHPEKKAEIVFQFTPFHLGITESSWTFLIPEHNITVPFLLVGKTTEPLISLNKSHLNFSSLLIGREARETVQIINKEEQGFDFSFQDNSRYSEGFSNSLLVCPMEGWIPPLSRFPIDIFFTPKQEGDVNFNLICNVEKKVHPVTLNVKAEGYTMNVEIKCKDRTGSITLLTPNQTNIINFYEVELNECVQCEFNFINTGKFTFSFQAQLCGSKTLLQYLEFSPIDSTVDVGQSVHATLSFQPLKKCVLTDLELIIKISHGPTFMCNISGCAVSPAIHFSFTSYNFGTCFIYQAGMPPYKQTLVITNKEETPMSIDCLYTNTTHLEVNSRVDVVKPGNTLEIPITFYPRESINYQELIPFEINGLSQQTVEIKGKGTKMKILVLDPANRIVKLGAVLPGQVVKRTVSIMNNSLAQLTFNQSILFTIPELQEPKVLTLAPFHNITLKPKEVCKLEVIFAPKKRVPPFSEEVFMECMGLLRPLFLLSGCCQALEISLDQEHIPFGPVVYQTQATRRILMMNTGDVGARFKWDIKKFEPHFSISPEEGYITSGMEVSFEVTYHPTEVGKESLCKNILCYIQGGSPLSLTLSGVCVGPPAVKEVVNFTCQVRSKHTQTILLSNRTNQTWNLHPIFEGEHWEGPEFITLEAHQQNKPYEITYRPRTMNLENRKHQGTLFFPLPDGTGWLYALHGTSELPKAVANIYREVPCKTPYTELLPITNWLNKPQRFRVIVEILKPEKPDLSITMKGLDYIDVLSGSKKDYKLNFFSHKEGTYAAKVIFRNEVTNEFLYYNVSFRVIPSGIIKTIEMVTPVRQVASASIKLENPLPYSVTFSTECRMPDIALPSQFVVPANSEGTFSFEFQPLKAGETFGRLTLHNTDLGYYQYELYLKATPALPEKPVHFQTVLGSSQIILVKFINYTRQRTEYYCRTDCTDFHAEKLINAAPGGQGGTEASVEVLFEPSHLGETKGILILSSLAGGEYIIPLFGMALPPKPQGPFSIRAGYSIIIPFKNVFYHMVTFSIIVDNPAFTIRAGESVRPKKINNITVSFEGNPSGSKTPITTKLTVSCPPGEGSETGVKWVYYLKGITL

SEQ ID NO: 49493 - protein, 950 aa, Homo sapiens
MESAGGFKLGMEPLSGGGVCEKKKLLKMTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFR

SEQ ID NO: 49494 - protein, 940 aa, Homo sapiens
MESAGGFKLGEKKKLLKMTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFR

SEQ ID NO: 49495 - protein, 5120 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRIVKEKLVCHAIIGAQKGKSLVMAVNITCEFVAPLIQLSTKQLIYRLEKKPNSILKPDYQPLAIKNISTLPVNLLLSTSGPFFICETDKSLLPATPEPIKLEIDEEKNLLIKFDPSYRNDLNNWVAEEILAIKYVEHPQIDSLDLRGEVHYPNLSFETKELDFGCILNDTELIRYVTITNCSPLVVKFRWFFLVNDEENQIRFVTLPKKPYSAPVSQMESIPATSEAASPPAILVTVESPEMDLNDFVKTVLVDEDARPEEKELRKTKASSVISDVRCPFHGEERIYSSQSQVEDQESLQTCEQNEMLSIGIEEVFDILPLFGVLQPHSSHQISFTFYGHANIIAQAKALCEVEEGPTYEITLKGEASLVNYSFDTKDIHYGLQLFDHVTEREITLTNMGKVGFEFKVLTDHQSSPDNLLPGVPLILPVSGFISSHQEQVLKVYYLPGVPEVFKRSFQIQIAHLDPENITLSGEGIFPQICLDLPRNLTANEKYEMFLNQARKNTDKEYNKCEMLDHFDIITEEVPEDEPAEVSAHLQMEVERLIVQSYVLEHQKTTTPDPMDDPCFSHRSRRKLAKIQLPEYILDFGYIILGEVRTHIIKIINTSHFPVSFHADKRVLHETGFSTELDRVKNLPHCETEIFEVRFDPQGANLPVGSKEVILPIKVVGGPTVHICLQAKVTIPTMTLSRGKVDFATIQCGQCLVETIQLSNHLQVPCEWFVQSQKPVDKLEKHMPKYLRQKLRAELKPKTRIFEIQPISGVLDPGEKSNVQVKFMPKEEKFYSQTLVFQIAQSAQKLTLLARGQGLEPRLEFSPSVLDLGPLLLCAPGDEAEVIVKNPCNFPIEFYSLEFDQQYLIEEKILRKLKGYDSYNTLLLPPRNPGEKLPPELYEYFKEIKKSKEEQMRAKYLENLAQENEEEDITSSDQGTSNSTKRTSLSRGISVTSNLEEWHALLVESKTYLEEEEDEESLEKIIFQTDKLQSIDSHSMEEVGEVENNPVSKAIARHLGIDISAEGRLAKNRKGIAIIIHGTPLSGKSANAVSVAKYYNAACLSIDSIVLEAVANSNNIPGIRARELCIRAAIEQSVKEGEEAAQEAAVGQNVIGQGRLSTDTLGKLASEMTLVAPEIKPGKSVRGSVVITKSKADSHGSGSQKQHHSHQSETPQISSSPLPPGPIHRWLSVSPSVGGETGLMSCVLPDELLVQILAERIQLSDCYRGVVFDGLDTLFAQNAAAALLCLLKAIGSREHIYILNMAQDYAAMKAQEKAKKEQEERKHKGALEKEKERLQNMDEEEYDALTEEEKLTFDRGIQQALRERKKREQERLAKEMQEKKLQQELERQKEEDELKRRVKKGKQGPIKEEPPMKKSQAANKQVPPLTKVDVKMETIERKISVREQTMSEKEELNKKKRNMGDVSMHGLPLVQDQEDSEGDNSKDPDKQLAPKFKTYELTLKDVQNILMYWDRKQGVQLPPAGMEEAPHEPDDQRQVPLGGRRGRKDRERERLEKERTEKERLEREKAERERLEKLRALEERSDWEGEGEEDHEGKKEKDLGVPFLDIQTPDFEGLSWKQALESDKLPKGEQILDILGLGASGPPIPPPALFSIVSYPVKRPPLTMTDDLEHFVFVIPPSEDISLDEKKEMEIESDFLATTNTTKAQEEQTSSSKGGKQKMKEKIDQVFEIQKDKRHMALNRKVLSGEPAGTISQLSDTDLDNFNGQHSQEKFTRLNHFRWIVPANGEVTLQVHFSSDEFGNFDQTFNFEILGTCCQYQLYCRGICTYPYICQDPKVVFPQRKMDMKTNEVIFKKYVMSTETYYFGPLLCGKSRDKYKSSLFPGNMETLTILNTSLMVVEASFYFQNDVKANTYFLEPNTMVLKPNEKQILNVWAYPTSVGVFEDSIVCCINDNPEPAIFQLSCQGIRPELELEPRQLHFDRLLLHRQESRVVLLRNVTLLPVAWRITSLEHLGDDFTVSLMQGTIPPEAEYGLHLYFQPTKPVNIKKAIRLEVLDAENLLGVVQIENIMVFAEAYDIALDITFPKGAEGGLDFGIVRVTEEAKQPLQLKNRGKYEIAFSFSVDSVGISTPNINSMISVQPKKGSLTPTEKPTNVQVFFHAKKEVKIEHQPVLRCQIIEPNISEGGEIIASIPIKFSANAVYSKYNITPSSVINFGALICGTRKSTTFTIENQGVTDFKFALYKLTGESPIHQKKAASHVRHARSRESESFYKTGSSRAAKFSDTIQKEVTTTGQARFAHGMFTVYPGFGSIPSGGQQVINVDCVADAMGKCEEFIAIDISGRDPAVHPAGILYTLLAEACLPAFVTENNALIFEEHQICTSANLHHILQTIESGGLFVEDENKFIFCNVLVGRQAKARFKISNVGKITCDVNIVVRPISNKPFARIVDIFEVEPSKMCIASHSHAFATVSFTPQIMQNYQCIFEATLDGLPSTLAKSRGLVFDIAGEGNLPRVTVVRPVLHNQYGNPLLLFKRLLLGHSEKLPLILKNNGVLPAQLHVDLQDELGVFSLKGRPTTAYIYITEENKPHVKAKKAHTASLVVSPGDTAEFDVVFHSQKVGRMRGIIHLSVINNQYEETSIHMVGEGYEDDITLDNIHGLVAPTSQEDISISEFTEIIEDNDMEDLVAAALVDHIQFGDCHIGHSYNASFTVTNHSQVNLIRFEWPVSATIAFSPQMGHLHPGCAKDIVVTMKSDVPINLKNMRIRCKLSRIMFQLPADQVPDWDDRMHTVKWVDVPRNMPGTFTTKRKVIETDPEPAHSVLEENYQELQLQISANVDFASYHCQARDVRFKETLVYQTRVFEFDVINSGRVQLEFSWVSEDTSKAVSFAKPDHQGSAQKDQLSQGTMHTGSTLDSTMDHWAEGSPQPFSVEPSSGIVPVGKIQKFKVKFSPLDIGDFESNLFCQIPNLPPGEQGPVLVAKGRSTLPICHFDLKDSDYISGHQRNPELRGSSGGALDPNTRVIEFTTVGIGGKNLRTFTILNPTNSTYSFCWISEEIESLQNPAAFTCLTEKGFIHPEKKAEIVFQFTPFHLGITESSWTFLIPEHNITVPFLLVGKTTEPLISLNKSHLNFSSLLIGREARETVQIINKEEQGFDFSFQDNSRYSEGFSNSLLVCPMEGWIPPLSRFPIDIFFTPKQEGDVNFNLICNVEKKVHPVTLNVKAEGYTMNVEIKCKDRTGSITLLTPNQTNIINFYEVELNECVQCEFNFINTGKFTFSFQAQLCGSKTLLQYLEFSPIDSTVDVGQSVHATLSFQPLKKCVLTDLELIIKISHGPTFMCNISGCAVSPAIHFSFTSYNFGTCFIYQAGMPPYKQTLVITNKEETPMSIDCLYTNTTHLEVNSRVDVVKPGNTLEIPITFYPRESINYQELIPFEINGLSQQTVEIKGKGTKMKILVLDPANRIVKLGAVLPGQVVKRTVSIMNNSLAQLTFNQSILFTIPELQEPKVLTLAPFHNITLKPKEVCKLEVIFAPKKRVPPFSEEVFMECMGLLRPLFLLSGCCQALEISLDQEHIPFGPVVYQTQATRRILMMNTGDVGARFKWDIKKFEPHFSISPEEGYITSGMEVSFEVTYHPTEVGKESLCKNILCYIQGGSPLSLTLSGVCVGPPAVKEVVNFTCQVRSKHTQTILLSNRTNQTWNLHPIFEGEHWEGPEFITLEAHQQNKPYEITYRPRTMNLENRKHQGTLFFPLPDGTGWLYALHGTSELPKAVANIYREVPCKTPYTELLPITNWLNKPQRFRVIVEILKPEKPDLSITMKGLDYIDVLSGSKKDYKLNFFSHKEGTYAAKVIFRNEVTNEFLYYNVSFRVIPSGIIKTIEMVTPVRQVASASIKLENPLPYSVTFSTECRMPDIALPSQFVVPANSEGTFSFEFQPLKAGETFGRLTLHNTDLGYYQYELYLKATPALPEKPVHFQTVLGSSQIILVKFINYTRQRTEYYCRTDCTDFHAEKLINAAPGGQGGTEASVEVLFEPSHLGETKGILILSSLAGGEYIIPLFGMALPPKPQGPFSIRAGYSIIIPFKNVFYHMVTFSIIVDNPAFTIRAGESVRPKKINNITVSFEGNPSGSKTPITTKLTVSCPPGEGSETGVKWVYYLKGITL

SEQ ID NO: 49496 - protein, 1017 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRVRG

SEQ ID NO: 49497 - protein, 740 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFATQELRDPQVLIPFQRFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITASAPELCNRKVMLSVLQWKIHRAKRSLPRDTVAVT

SEQ ID NO: 49498 - protein, 1214 aa, Homo sapiens
MTSRRLEESMGAVQMGLVNMFKGFQSKVLPPLSPKVVTEEEVNRMLTPSEFLKEMSLTTEQRLAKTRLMCRPQIIELLDMGETTHQKFSGIDLDQALFQPFPSEIIFQNYTPCEVYEVPLILRNNDKIPRLVKVVEESSPYFKVISPKDIGHKVAPGVPSIFRILFTPEENKDYAHTLTCVTEREKFIVPIKARGARAILDFPDKLNFSTCPVKYSTQKILLVRNIGNKNAVFHIKTCRPFSIEPAIGTLNVGESMQLEVEFEPQSVGDHSGRLIVCYDTGEKVFVSLYGAAIDMNIRLDKNSLTIEKTYISLANQRTITIHNRSNIIAHFLWKVFATQQEEDREKYRACDDLIKEEKDETDEFFEECITDPLLREHLSVLSRTFANQRRLVQGDSKLFFNNVFTVEPLEGDVWPNSSAEITVYFNPLEAKLYQQTIYCDILGREIRLPLRIKGEGMGPKIHFNFELLDIGKVFTGSAHCYEAILYNKGSIDALFNMTPPTSALGACFVFSPKEGIIEPSGVQAIQISFSSTILGNFEEEFLVNVNGSPEPVKLTIRGCVIGPTFHFNVPALHFGDVSFGFPHTLICSLNNTSLIPMTYKLRIPGDGLGHKSISYCEQHVDYKRPSWTKEEISSMKPKEFTISPDCGTIRPQGFAAIRVTLCSNTVQKYELALVVDVEGIGEEVLALLITARCVVPALHLVNTEVDFGHCFLKYPYEKTLQLANQDDLPGFYEVQPQVCEEVPTVLFSSPTPSGVISPSSTIHIPLVLETQVTGEHRSTVYISIFGSQDPPLVCHLKSAGEGPVIYVHPNQVDFGNIYVLKDSSRILNLCNQSFIPAFFQAHMAHKKSLWTIEPNEGMVPPETDVQLALTANLNDTLTFKDCVILDIENSSTYRIPVQASGTGSTIVSDKPFAPELNLGAHFSLDTHYYHFKLINKGRRIQQLFWMNDSFRPQAKLSKKGRVKKGHAHVQPQPSGSQEPRDPQSPVFHLHPASMELYPGQAIDVILEGYSATPRKPNSILKPDYQPLAIKNISTLPVNLLLSTSGPFFICETDKSLLPATPEPIKLEIDEEKNLLIKFDPSYRNDLNNWVAEEILAIKYVEHPQIDSLDLRGEVHYPNLSFETKELDFGCILNDTELIRYVTITNCSPLVVKFRWFFLVNDEENQIRFVTLPKKPYSAPVSQMESIPATSEAASPPAILVTVESPEMDLNDFVK

SEQ ID NO: 49499 - protein, 1017 aa, Homo sapiens; identical to SEQ ID NO: 49496

SEQ ID NO: 49500 - protein, 273 aa, Homo sapiens
MATWDEKAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 49501 - protein, 273 aa, Homo sapiens; identical to SEQ ID NO: 49500

SEQ ID NO: 49502 - protein, 78 aa, Homo sapiens
MATWDEKAVTRRAKVAPAERMSKFLRHFTVVGDDYHAWNINYKKWENEEEEEEEEQPPPTPVSGEEGRAAAPDVAPAP

SEQ ID NO: 49503 - protein, 299 aa, Homo sapiens
MEELLPDGQIWANMDPEERMLAAATAFTHICAGQGEGDVRREAQSIQYDPYSKASVAPGKRPALPVQLQYPHVESNVPSETVSEASQRLRKPVMKRKVLRRKPDGEVLVTDESIISESESGTENDQDLWDLRQRLMNVQFQEDKESSFDVSQKFNLPHEYQGISQDQLICSLQREGMGSPAYEQDLIVASRPKSFILPKLDQLSRNRGKTDRVARYFEYKRDWDSIRLPGEDHRKELRWGVREQMLCRAEPQSKPQHIYVPNNYLVPTEKKRSALRWGVRCDLANGVIPRKLPFPLSPS

SEQ ID NO: 49504 - protein, 299 aa, Homo sapiens; identical to SEQ ID NO: 49503

SEQ ID NO: 49505 - protein, 299 aa, Homo sapiens; identical to SEQ ID NO: 49503

SEQ ID NO: 49506 - protein, 370 aa, Homo sapiens
MLPRLICINDYEQHAKSVLPKSIYDYYRSGANDEETLADNIAAFSRWKLYPRMLRNVAETDLSTSVLGQRVSMPICVGATAMQRMAHVDGELATVRACQSLGTGMMLSSWATSSIEEVAEAGPEALRWLQLYIYKDREVTKKLVRQAEKMGYKAIFVTVDTPYLGNRLDDVRNRFKLPPQLRMKNFETSTLSFSPEENFGDDSGLAAYVAKAIDPSISWEDIKWLRRLTSLPIVAKGILRGDDAREAVKHGLNGILVSNHGARQLDGVPATIDVLPEIVEAVEGKVEVFLDGGVRKGTDVLKALALGAKAVFVGRPIVWGLAFQGEKGVQDVLEILKEEFRLAMALSGCQNVKVIDKTLVRKNPLAVSKI

SEQ ID NO: 49507 - protein, 351 aa, Homo sapiens
MSLVCLTDFQAHAREQLSKSTRDFIEGGADDSITRDDNIAAFKRIRLRPRYLRDVSEVDTRTTIQGEEISAPICIAPTGFHCLVWPDGEMSTARAAQAAGICYITSTFASCSLEDIVIAAPEGLRWFQLYVHPDLQLNKQLIQRVESLGFKALVITLDTPVCGNRRHDIRNQLRRNLTLTDLQSPKKGNAIPYFQMTPISTSLCWNDLSWFQSITRLPIILKGILTKEDAELAVKHNVQGIIVSNHGGRQLDEVLASIDALTEVVAAVKGKIEVYLDGGVRTGNDVLKALALGAKCIFLGRPILWGLACKGEHGVKEVLNILTNEFHTSMALTGCRSVAEINRNLVQFSRL

SEQ ID NO: 49508 - protein, 364 aa, Homo sapiens
MEDKMWSECEGPEMSLVCLTDFQAHAREQLSKSTRDFIEGGADDSITRDDNIAAFKRIRLRPRYLRDVSEVDTRTTIQGEEISAPICIAPTGFHCLVWPDGEMSTARAAQAAGICYITSTFASCSLEDIVIAAPEGLRWFQLYVHPDLQLNKQLIQRVESLGFKALVITLDTPVCGNRRHDIRNQLRRNLTLTDLQSPKKGNAIPYFQMTPISTSLCWNDLSWFQSITRLPIILKGILTKEDAELAVKHNVQGIIVSNHGGRQLDEVLASIDALTEVVAAVKGKIEVYLDGGVRTGNDVLKALALGAKCIFLGRPILWGLACKGEHGVKEVLNILTNEFHTSMALTGCRSVAEINRNLVQFSRL

SEQ ID NO: 49509 - protein, 186 aa, Homo sapiens
MSLVCLTDFQAHAREQLSKSTRDFIEGGADDSITRDDNIAAFKRIRLRPRYLRDVSEVDTRTTIQGEEISAPICIAPTGFHCLVWPDGEMSTARAPEGLRWFQLYVHPDLQLNKQLIQRVESLGFKALVITLDTPVCGNRRHDIRNQLRRNLTLTDLQSPKKGNAIPYFQMTPISTSLCWNDLSWF

SEQ ID NO: 49510 - protein, 763 aa, Homo sapiens
MVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 49511 - protein, 260 aa, Homo sapiens
MESKGMWQLFELTLPIQSMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQVNLFPFNVLLSVKGKLKIQSSV

SEQ ID NO: 49512 - protein, 474 aa, Homo sapiens
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 49513 - protein, 85 aa, Homo sapiens
MTILTYPFKNLPTASKWALRFSIRPLSCSSQLRAAPAVQTKTKKTLAKPNIRNVVVVDGVRTPFLLSGTSYKDLMPHDLARAALT

SEQ ID NO: 49514 - protein, 176 aa, Homo sapiens
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHS

SEQ ID NO: 49515 - protein, 150 aa, Homo sapiens
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVG

SEQ ID NO: 49516 - protein, 459 aa, Homo sapiens
MTILTYPFKNLPTASKWALRFSIRPLSCSSQLRAAPAVQTKTKKTLAKPNIRNVVVVDGVRTPFLLSGTSGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 49517 - protein, 452 aa, Homo sapiens
MTLVSGWLLYGWIIAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 49518 - protein, 260 aa, Homo sapiens [sequence omitted]

SEQ ID NO: 49519 - protein, 308 aa, Homo sapiens
MVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTGDTLFVAGCGKFYEGTADEMCKALLEVLGRLPPDTRVYCGHEYTINNLKFARHVEPGNAAIREKLAWAKEKYSIGEPTVPSTLAEEFTYNPFMRVREKTVQQHAGETDPVTTMRAVRREKDQFKMPRD

SEQ ID NO: 49520 - protein, 236 aa, Homo sapiens
MVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVTPCLWLAAGSSMKGLRMRCVKLCWRSWAGSPRTQESTVATSTPSTTSSLHATWSPAMPPSGRSWPGPRRSTASGSPQCHPPWQRSLPTTPS

SEQ ID NO: 49521 - protein, 375 aa, Homo sapiens
MAMTGWSCLVTGAGGFLGQRIIRLLVKEKELKEIRVLDKAFGPELREEFSKLQNKTKLTVLEGDILDEPFLKRACQDVSVIIHTACIIDVFGVTHRESIMNVNVKGTQLLLEACVQASVPVFIYTSSIEVAGPNSYKEIIQNGHEEEPLENTWPAPYPHSKKLAEKAVLAANGWNLKNGGTLYTCALRPMYIYGEGSRFLSASINEALNNNGILSSVGKFSTVNPVYVGNVAWAHILALRALQDPKKAPSIRGQFYYISDDTPHQSYDNLNYTLSKEFGLRLDSRWSFPLSLMYWIGFLLEIVSFLLRPIYTYRPPFNRHIVTLSNSVFTFSYKKAQRDLAYKPLYSWEEAKQKTVEWVGSLVDRHKETLKSKTQ

SEQ ID NO: 49522 - protein, 373 aa, Homo sapiens
MTGWSCLVTGAGGFLGQRIIRLLVKEKELKEIRVLDKAFGPELREEFSKLQNKTKLTVLEGDILDEPFLKRACQDVSVIIHTACIIDVFGVTHRESIMNVNVKGTQLLLEACVQASVPVFIYTSSIEVAGPNSYKEIIQNGHEEEPLENTWPAPYPHSKKLAEKAVLAANGWNLKNGGTLYTCALRPMYIYGEGSRFLSASINEALNNNGILSSVGKFSTVNPVYVGNVAWAHILALRALQDPKKAPSIRGQFYYISDDTPHQSYDNLNYTLSKEFGLRLDSRWSFPLSLMYWIGFLLEIVSFLLRPIYTYRPPFNRHIVTLSNSVFTFSYKKAQRDLAYKPLYSWEEAKQKTVEWVGSLVDRHKETLKSKTQ

SEQ ID NO: 49523 - protein, 373 aa, Homo sapiens; identical to SEQ ID NO: 49522

SEQ ID NO: 49524 - protein, 82 aa, Homo sapiens
MTGWSCLVTGAGGFLGQRIIRLLVKEKELKEIRVLDKAFGPELREEFSKLQNKTKLTVLEGDILDEPFLKRACQDVSVIIHT

SEQ ID NO: 49525 - protein, 372 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKNGDTLYTCALRPTYIYGEGGPFLSASINEALNNNGILSSVGKFSTVNPVYVGNVAWAHILALRALRDPKKAPSVRGQFYYISDDTPHQSYDNLNYILSKEFGLRLDSRWSLPLTLMYWIGFLLEVVSFLLSPIYSYQPPFNRHTVTLSNSVFTFSYKKAQRDLAYKPLYSWEEAKQKTVEWVGSLVDRHKETLKSKTQ

SEQ ID NO: 49526 - protein, 195 aa, Homo sapiens
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKNGDTLYTCALRPTYIYGEGGP

SEQ ID NO: 49527 - protein, 372 aa, Homo sapiens; identical to SEQ ID NO: 49525

SEQ ID NO: 49528 - protein, 196 aa, Homo sapiens
MADSAQAQKLVYLVTGGCGFLGEHVVRMLLQREPRLGELRVFDQHLGPWLEELKTGPVRVTAIQGDVTQAHEVAAAVAGAHVVIHTAGLVDVFGRASPKTIHEVNVQGTRNVIEACVQTGTRFLVYTSSMEVVGPNTKGHPFYRGNEDTPYEAVHRHPYPCSKALAEWLVLEANGRKAMLPGCTCWQPGSWSSGQP

SEQ ID NO: 49529 - protein, 369 aa, Homo sapiens
MADSAQAQKLVYLVTGGCGFLGEHVVRMLLQREPRLGELRVFDQHLGPWLEELKTGPVRVTAIQGDVTQAHEVAAAVAGAHVVIHTAGLVDVFGRASPKTIHEVNVQGTRNVIEACVQTGTRFLVYTSSMEVVGPNTKGHPFYRGNEDTPYEAVHRHPYPCSKALAEWLVLEANGRKVRGGLPLVTCALRPTGIYGEGHQIMRDFYRQGLRLGGWLFRAIPASVEHGRVYVGNVAWMHVLAARELEQRATLMGGQVYFCYDGSPYRSYEDFNMEFLGPCGLRLVGARPLLPYWLLVFLAALNALLQWLLRPLVLYAPLLNPYTLAVANTTFTVSTDKAQRHFGYEPLFSWEDSRTRTILWVQAATGSAQ

SEQ ID NO: 49530 - protein, 196 aa, Homo sapiens; identical to SEQ ID NO: 49528

SEQ ID NO: 49531 - protein, 361 aa, Homo sapiens [sequence omitted]

SEQ ID NO: 49532 - protein, 344 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQGALGVEVRAKDQDILDLVGVLHDPETLLRCIAERAFLRHLEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 49533 - protein, 344 aa, Homo sapiens; identical to SEQ ID NO: 49532

SEQ ID NO: 49534 - protein, 187 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQ

SEQ ID NO: 49535 - protein, 344 aa, Homo sapiens; identical to SEQ ID NO: 49532

SEQ ID NO: 49536 - protein, 187 aa, Homo sapiens; identical to SEQ ID NO: 49534

SEQ ID NO: 49537 - protein, 304 aa, Homo sapiens
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 49538 - protein, 321 aa, Homo sapiens
MSGNGNAAATAEENSPKMRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 49539 - protein, 292 aa, Homo sapiens
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEFLYSTSYNMDRFINK

SEQ ID NO: 49540 - protein, 292 aa, Homo sapiens; identical to SEQ ID NO: 49539

SEQ ID NO: 49541 - protein, 292 aa, Homo sapiens; identical to SEQ ID NO: 49539

SEQ ID NO: 49542 - protein, 405 aa, Homo sapiens
MERWPWPSGGAWLLVAARALLQLLRSDLRLGRPLLAALALLAALDWLCQRLLPPPAALAVLAAAGWIALSRLARPQRLPVATRAVLITGCDSGFGKETAKKLDSMGFTVLATVLELNSPGAIELRTCCSPRLRLLQMDLTKPGDISRVLEFTKAHTTSTGLWGLVNNAGHNEVVADAELSPVATFRSCMEVNFFGALELTKGLLPLLRSSRGRIVTVGSPAGDMPYPCLGAYGTSKAAVALLMDTFSCELLPWGVKVSIIQPGCFKTESVRNVGQWEKRKQLLLANLPQELLQAYGKDYIEHLHGQFLHSLRLAMSDLTPVVDAITDALLAARPRRRYYPGQGLGLMYFIHYYLPEGLRRRFLQAFFISHCLPRALQPGQPGTTPPQDAAQDPNLSPGPSPAVAR

SEQ ID NO: 49543 - protein, 149 aa, Homo sapiens
MARTVVLITGCSSGIGLHLAVRLASDPSQSFKVYATLRDLKTQGRLWEAARALACPPGSLETLQLDVRDSKSVAAARERVTEGRVDVLVCNAGLGLLGPLEALGEDAVASVLDVNVVGTVRMLQAFLPDMKRRGSGRVLVTGSVGGLMA

SEQ ID NO: 49544 - protein, 328 aa, Homo sapiens
MARTVVLITGCSSGIGLHLAVRLASDPSQSFKVYATLRDLKTQGRLWEAARALACPPGSLETLQLDVRDSKSVAAARERVTEGRVDVLVCNAGLGLLGPLEALGEDAVASVLDVNVVGTVRMLQAFLPDMKRRGSGRVLVTGSVGGLMGLPFNDVYCASKFALEGLCESLAVLLLPFGVHLSLIECGPVHTAFMEKVLGSPEEVLDRTDIHTFHRFYQYLAHSKQVFREAAQNPEEVAEVFLTALRAPKPTLRYFTTERFLPLLRMRLDDPSGSNYVTAMHREVFGDVPAKAEAGAEAGGGAGPGAEDEAGRGAVGDPELGDPPAAPQ

SEQ ID NO: 49545 - protein, 328 aa, Homo sapiens; identical to SEQ ID NO: 49544

SEQ ID NO: 49546 - protein, 148 aa, Homo sapiens
MACTVVLITGCSSGIGLHLAIHLALDPSQSFKVYATLRDLKTQGRLWEAARALACPQGSLERLQLDVRNSSSLAAARERVTEGRVDVLVCDTGLGLLGPLGEDAVASVLDVNVVGTVRVLQDFLPDMKRPGSGRVLVTGSMGGLMGEW

SEQ ID NO: 49547 - protein, 261 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVGQAAYSASKGGIVGMTLPIARDLAPIGIRVMTIAPGLFGTPLLTSLPEKVCNFLASQVPFPSRLGDPAEYAHLVQAIIENPFLNGEVIRLDGAIRMQP

SEQ ID NO: 49548 - protein, 169 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVCLAPHC

SEQ ID NO: 49549 - protein, 252 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVGQAAYSASKGGIVGMTLPIARDLAPIGLFGTPLLTSLPEKVCNFLASQVPFPSRLGDPAEYAHLVQAIIENPFLNGEVIRLDGAIRMQP

SEQ ID NO: 49550 - protein, 300 aa, Homo sapiens
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKQKISVKFDAVIGYKMKAQ

SEQ ID NO: 49551 - protein, 264 aa, Homo sapiens
MNIILEILLLLITIIYSYLESLVKFFIPQRRKSVAGEIVLITGAGHGIGRQTTYEFAKRQSILVLWDINKVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 49552 - protein, 300 aa, Homo sapiens
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 49553 - protein, 270 aa, Homo sapiens
MATGTRYAGKVVVVTGGGRGIGAGIVRAFVNSGARVVICDKDESGGRALEQELPGAVFILCDVTQEDDVKTLVSETIRRFGRLDCVVNNAGHHPPPQRPEETSAQGFRQLLELNLLGTYTLTKLALPYLRKSQGNVINISSLVGAIGQAQAVPYVATKGAVTAMTKALALDESPYGVRVNCISPGNIWTPLWEELAALMPDPRATIREGMLAQPLGRMGQPAEVGAAAVFLASEANFCTGIELLVTGGAELGYGCKASRSTPVDAPDIPS

SEQ ID NO: 49554 - protein, 387 aa, Homo sapiens
MSTFFSDTAWICLAVPTVLCGTVFCKYKKSSGQLWSWMVCLAGLCAVCLLILSPFWGLILFSVSCFLMYTYLSGQELLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 49555 - protein, 260 aa, Homo sapiens
MGDVLEQFFILTGLLVCLACLAKCVRFSRCVLLNYWKVLPKSFLRSMGQWAVITGAGDGIGKAYSFELAKRGLNVVLISRTLEKLEAIATEIERTTGRSVKIIQADFTKDDIYEHIKEKLAGLEIGILVNNVGMLPNLLPSHFLNAPDEIQSLIHCNITSVVKMTQLILKHMESRQKGLILNISSGIALFPWPLYSMYSASKAFVCAFSKALQEEYKAKEVIIQAGFLSLIPAWAFYSGAFQRLLLTHYVAYLKLNTKVR

SEQ ID NO: 49556 - protein, 310 aa, Homo sapiens
MGDVLEQFFILTGLLVCLACLAKCVRFSRCVLLNYWKVLPKSFLRSMGQWAVITGAGDGIGKAYSFELAKRGLNVVLISRTLEKLEAIATEIERTTGRSVKIIQADFTKDDIYEHIKEKLAGLEIGILVNNVGMLPNLLPSHFLNAPDEIQSLIHCNITSVVKMTQLILKHMESRQKGLILNISSGIALFPWPLYSMYSASKAFVCAFSKALQEEYKAKEVIIQVLTPYAVSTAMTKYLNTNVITKTADEFVKESLNYVTIGGETCGCLAHEILAGFLSLIPAWAFYSGAFQRLLLTHYVAYLKLNTKVR

SEQ ID NO: 49557 - protein, 736 aa, Homo sapiens
MGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 49558 - protein, 761 aa, Homo sapiens
MVILEAPHLLRRKEPETPGLSSRIGPSLCPGFCRKRSVSCCFQNLCNNPMEKIISQCRFFVSMNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 49559 - protein, 712 aa, Homo sapiens
MEKIISQCRFFVSMNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 49560 - protein, 599 aa, Homo sapiens
MKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 49561 - protein, 718 aa, Homo sapiens
MGSPLRFDGRVVLVTGAGAVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 49562 - protein, 341 aa, Homo sapiens
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVFGHFILIRELEPLLCHSDNPSQLIWTSSRSARKSNFSLEDFQHSKGKEPYSSSKYATDLLSVALNRNFNQQGLYSNVACPGTALTNLTYGILPPFIWTLLMPAILLLRFFANAFTLTPYNGTEALVWLFHQKPESLNPLIKYLSATTGFGRNYIMTQKMDLDEDTAEKFYQKLLELEKHIRVTIQKTDNQARLSGSCL

SEQ ID NO: 49563 - protein, 111 aa, Homo sapiens
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSS

SEQ ID NO: 49564 - protein, 84 aa, Homo sapiens
MRKVVLITGASSGIGLALCKRLLAEDDELHLCLACRNMSKAEAVCAALLASHPTAEVTIVQVDVSNLQSVFRASKELKQRYISC

SEQ ID NO: 49565 - protein, 306 aa, Homo sapiens
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVFGHFILIRELEPLLCHSDNPSQLIWTSSRSARKSNFSLEDFQHSKGKEPYSSSKYATDLLSVALNRNFNQQLRFFANAFTLTPYNGTEALVWLFHQKPESLNPLIKYLSATTGFGRNYIMTQKMDLDEDTAEKFYQKLLELEKHIRVTIQKTDNQARLSGSCL

SEQ ID NO: 49566 - protein, 119 aa, Homo sapiens
VVIRELEPLLCHSDNPSQLIWTSSRSARKSNFSLEDFQHSKGKEPYSSSKYATDLLSVALNRNFNQQLRFFANAFTLTPYNGTEALVWLFHQKPESLNPLIKYLSATTGFGRNYIMTQK

SEQ ID NO: 49567 - protein, 261 aa, Homo sapiens
MASQLQNRLRSALALVTGAGSGIGRAVSVRLAGEGATVAACDLDRAAAQETVRLLGGPGSKEGPPRGNHAAFQADVSEARAARCLLEQVQACFSRPPSVVVSCAGITQDEFLLHMSEDDWDKVIAVNLKGTFLVTQAAAQALVSNGCRGSIINISSIVGKVGNVGQTNYAASKAGVIGLTQTAARELGRHGIRCNSVLPGFIATPMTQKVPQKVVDKITEMIPMGHLGDPEDVADVVAFLASEDSGYITGTSVEVTGGLFM

SEQ ID NO: 49568 - protein, 261 aa, Homo sapiens; identical to SEQ ID NO: 49567

SEQ ID NO: 49569 - protein, 261 aa, Homo sapiens; identical to SEQ ID NO: 49567

SEQ ID NO: 49570 - protein, 261 aa, Homo sapiens; identical to SEQ ID NO: 49567

SEQ ID NO: 49571 - protein, 261 aa, Homo sapiens; identical to SEQ ID NO: 49567

SEQ ID NO: 49572 - protein, 261 aa, Homo sapiens; identical to SEQ ID NO: 49567

SEQ ID NO: 49573 - protein, 615 aa, Homo sapiens
MVSGPLALRWCAWAGRGDMGPDMELPSHSKQLLLQLNQQRTKGFLCDVIIMVENSIFRAHKNVLAASSIYFKSLVLHDNLINLDTDMVSSTVFQQILDFIYTGKLLPSDQPAEPNFSTLLTAASYLQLPELAALCRRKLKRAGKPFGSGRAGSTGMGRPPRSQRLSTASVIQARYQGLVDGRKGAHAPQELPQAKGSDDELFLGGSNQDSVQGLGRAVCPAGGEAGLGGCSSSTNGSSGGCEQELGLDLSKKSPPLPPATPGPHLTPDDAAQLSDSQHGSPPAASAPPVANSASYSELGGTPDEPMDLEGAEDNHLSLLEAPGGQPRKSLRHSTRKKEWGKKEPVAGSPFERREAGPKGPCPGEEGEGVGDRVPNGILASGAGPSGPYGEPPYPCKEEEENGKDASEDSAQSGSEGGSGHASAHYMYRQEGYETVSYGDNLYVCIPCAKGFPSSEQLNAHVETHTEEELFIKEEGAYETGSGGAEEEAEDLSAPSAAYTAEPRPFKCSVCEKTYKDPATLRQHEKTHWLTRPFPCNICGKMFTQRGTMTRHMRSHLGLKPFACDECGMRFTRQYRLTEHMRVHSGEKPYECQLCGGKFTQQRNLISHLRMHTSPS

SEQ ID NO: 49574 - protein, 615 aa, Homo sapiens; identical to SEQ ID NO: 49573

SEQ ID NO: 49575 - protein, 615 aa, Homo sapiens; identical to SEQ ID NO: 49573

SEQ ID NO: 49576 - protein, 889 aa, Homo sapiens
MDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLFPPPPPPPQVTSAIATLQQAAAMSFCPQVARPLVGPLALGSPRLVRRPPPGPAPAAASPGPPPPASPPGAPASPRAPRTSPYGGLPAAPLAGPALPARRLSRASRPLSASQPSLPHGAPGPAASTRPASSSTPRLGPTPAARAAAPSPDRRDSASPGAAGGLDPQDSARSRLSSNL

SEQ ID NO: 49577 - protein, 774 aa, Homo sapiens
MEAEQRPAAGASEGATPGLEAVPPVAPPPATAASGPIPKSGPEPKRRHLGTLLQPTVNKFSLRVFGSHKAVEIEQERVKSAGAWIIHPYSDFRFYWDLIMLLLMVGNLIVLPVGITFFKEENSPPWIVFNVLSDTFFLLDLVLNFRTGIVVEEGAEILLAPRAIRTRYLRTWFLVDLISSIPVDYIFLVVELEPRLDAEVYKTARALRIVRFTKILSLLRLLRLSRLIRYIHQWEEIFHMTYDLASAVVRIFNLIGMMLLLCHWDGCLQFLVPMLQDFPPDCWVSINHMVNHSWGRQYSHALFKAMSHMLCIGYGQQAPVGMPDVWLTMLSMIVGATCYAMFIGHATALIQSLDSSRRQYQEKYKQVEQYMSFHKLPADTRQRIHEYYEHRYQGKMFDEESILGELSEPLREEIINFTCRGLVAHMPLFAHADPSFVTAVLTKLRFEVFQPGDLVVREGSVGRKMYFIQHGLLSVLARGARDTRLTDGSYFGEICLLTRGRRTASVRADTYCRLYSLSVDHFNAVLEEFPMMRRAFETVAMDRLLRIGKKNSILQRKRSEPSPGSSGGIMEQHLVQHDRDMARGVRGRAPSTGAQLSGKPVLWEPLVHAPLQAAAVTSNVAIALTHQRGPLPLSPDSPATLLARSAWRSAGSPASPLVPVRAGPWASTSRLPAPPARTLHASLSRAGRSQVSLLGPPPGGGGRRLGPRGRPLSASQPSLPQRATGDGSPGRKGSGSERLPPSGLLAKPPRTAQPPRPPVPEPATPRGLQLSANM

SEQ ID NO: 49578 - protein, 1203 aa, Homo sapiens
MDKLPPSMRKRLYSLPQQVGAKAWIMDEEEDAEEEGAGGRQDPSRRSIRLRPLPSPSPSAAAGGTESRSSALGAADSEGPARGAGKSSTNGDCRRFRGSLASLGSRGGGSGGTGSGSSHGHLHDSAEERRLIAEGDASPGEDRTPPGLAAEPERPGASAQPAASPPPPQQPPQPASASCEQPSVDTAIKVEGGAAAGDQILPEAEVRLGQAGFMQRQFGAMLQPGVNKFSLRMFGSQKAVEREQERVKSAGFWIIHPYSDFRFYWDLTMLLLMVGNLIIIPVGITFFKDENTTPWIVFNVVSDTFFLIDLVLNFRTGIVVEDNTEIILDPQRIKMKYLKSWFMVDFISSIPVDYIFLIVETRIDSEVYKTARALRIVRFTKILSLLRLLRLSRLIRYIHQWEEIFHMTYDLASAVVRIVNLIGMMLLLCHWDGCLQFLVPMLQDFPDDCWVSINNMVNNSWGKQYSYALFKAMSHMLCIGYGRQAPVGMSDVWLTMLSMIVGATCYAMFIGHATALIQSLDSSRRQYQEKYKQVEQYMSFHKLPPDTRQRIHDYYEHRYQGKMFDEESILGELSEPLREEIINFNCRKLVASMPLFANADPNFVTSMLTKLRFEVFQPGDYIIREGTIGKKMYFIQHGVVSVLTKGNKETKLADGSYFGEICLLTRGRRTASVRADTYCRLYSLSVDNFNEVLEEYPMMRRAFETVALDRLDRIGKKNSILLHKVQHDLNSGVFNYQENEIIQQIVQHDREMAHCAHRVQAAASATPTPTPVIWTPLIQAPLQAAAATTSVAIALTHHPRLPAAIFRPPPGSGLGNLGAGQTPRHLKRLQSLIPSALGSASPASSPSQVDTPSSSSFHIQQLAGFSAPAGLSPLLPSSSSSPPPGACGSPSAPTPSAGVAATTIAGFGHFHKALGGSLSSSDSPLLTPLQPGARSPQAAQPSPAPPGARGGLGLPEHFLPPPPSSRSPSSSPGQLGQPPGELSLGLATGPLSTPETPPRQPEPPSLVAGASGGASPVGFTPRGGLSPPGHSPGPPRTFPSAPPRASGSHGSLLLPPASSPPPPQVPQRRGTPPLTPGRLTQDLKLISASQPALPQDGAQTLRRASPHSSGESMAAFPLFPRAGGGSGGSGSSGGLGPPGRPYGAIPGQHVTLPRKTSSGSLPPPLSLFGARATSSGGPPLTAGPQREPGARPEPVRSKLPSNL

SEQ ID NO: 49579 - protein, 131 aa, Homo sapiens
MNLPSTKVSWAAVTLLLLLLLLPPALLSSGAAAQPLPDCCRQKTCSCRLYELLHGAGNHAAGILTLGKRRSGPPGLQGRLQRLLQASGNHAAGILTMGRRAGAEPAPRPCLGRRCSAPAAASVAPGGQSGI

SEQ ID NO: 49580 - protein, 349 aa, Homo sapiens
MAATAAEAVASGSGEPREEAGALGPAWDESQLRSYSFPTRPIPRLSQSDPRAEELIENEEPVVLTDTNLVYPALKWDLEYLQENIGNGDFSVYSASTHKFLYYDEKKMANFQNFKPRSNREEMKFHEFVEKLQDIQQRGGEERLYLQQTLNDTVGRKIVMDFLGFNWNWINKQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYKGAPTPKRIEYPLKAHQKVAIMRNIEKMLGEALGNPQEVGPLLNTMIKGRYN

SEQ ID NO: 49581 - protein, 382 aa, Homo sapiens
MVSVGCVVFLFFFFGVRNRRSFRFRWGPSLAAEMAATAAEAVASGSGEPREEAGALGPAWDESQLRSYSFPTRPIPRLSQSDPRAEELIENEEPVVLTDTNLVYPALKWDLEYLQENIGNGDFSVYSASTHKFLYYDEKKMANFQNFKPRSNREEMKFHEFVEKLQDIQQRGGEERLYLQQTLNDTVGRKIVMDFLGFNWNWINKQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYKGAPTPKRIEYPLKAHQKVAIMRNIEKMLGEALGNPQEVGPLLNTMIKGRYN

SEQ ID NO: 49582 - protein, 192 aa, Homo sapiens
MANFQNFKPRSNREEMKFHEFVEKLQDIQQRGGEERLYLQQTLNDTVGRKIVMDFLGFNWNWINKQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYKG

SEQ ID NO: 49583 - protein, 600 aa, Homo sapiens
MRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 49584 - protein, 450 aa, Homo sapiens
MRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDPSTPLLNLNEPLGFHFVTQSGVQWHKHSSPQPRPPGLK

SEQ ID NO: 49585 - protein, 632 aa, Homo sapiens
MALGLQRARSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLVCWGINGILWPSLPSWLKPTVL

SEQ ID NO: 49586 - protein, 576 aa, Homo sapiens
MRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLVCWGINGILWPSLPSWLKPTVL

SEQ ID NO: 49587 - protein, 667 aa, Homo sapiens
MDWQDHRSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 49588 - protein, 613 aa, Homo sapiens
MRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 49589 - protein, 669 aa, Homo sapiens
MALGLQRARSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 49590 - protein, 363 aa, Homo sapiens
MALGLQRARSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTCMYPISPGAKPAATWPPADTRTPQLPIPQDALPPHLNTSSLLPKPQGTVSFLAPSYPVPRYFSPHLPPWWP

SEQ ID NO: 49591 - protein, 612 aa, Homo sapiens
MLPMPSGRPRSCARKSPGMRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGFHFVTQSGVQWHKHSSPQPRPPGLK

SEQ ID NO: 49592 - protein, 199 aa, Homo sapiens
MRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPMT

SEQ ID NO: 49593 - protein, 237 aa, Homo sapiens
MRPAAGAARRPRCCTSWLTRCPSPAASAPTWTRPLSCASPSATCACTASAPQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLERFVPVSSAATSLCLPSLSPSKVAGYSPDDLIGCSAYEYIHALDSDAPQDALPPHLNTSSLLPKPQGTVSFLAPSYPVPRYFSPHLPPWWP

SEQ ID NO: 49594 - protein, 363 aa, Homo sapiens; identical to SEQ ID NO: 49590

SEQ ID NO: 49595 - protein, 991 aa, Homo sapiens
MADKVRRQRPRRRVCWALVAVLLADLLALSDTLAVMSVDLGSESMKVAIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETAGSEPGDTEPLELGGPGAEPEQKEQSTGQKRPLKNDEL

SEQ ID NO: 49596 - protein, 999 aa, Homo sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 49597 - protein, 848 aa, Homo sapiens [sequence omitted]

SEQ ID NO: 49598 - protein, 679 aa, Homo sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPTSVCRASVTRFGF

SEQ ID NO: 49599 - protein, 147 aa, Homo sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPL

SEQ ID NO: 49600 - protein, 559 aa, Homo sapiens
MAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQMLFLCPARLPQSKQAIDRFHTAVTCMEPPWGRRCRARPAWRLCS

SEQ ID NO: 49601 - protein, 980 aa, Homo sapiens
MWQSRGPMLFHLGLCVGAAGMIREWFVPIRREKGSRLICPGGTMADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 49602 - protein, 110 aa, Homo sapiens
MAPRGCIVAVFAIFCISRLLCSHGAPVAPMTPYLMLCQPHKRCGDKFYDPLQHCCYDDAVVPLARTQTCGNCTFRVCFEQCCPWTFMVKLINQNCDSARTSDDRLCRSVS

SEQ ID NO: 49603 - protein, 119 aa, Homo sapiens
MVPRIFAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 49604 - protein, 130 aa, Homo sapiens
MRFSVSGMRTDYPRSVLAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 49605 - protein, 125 aa, Homo sapiens
MRPRCCILALVCWITVFLLQCSKGTTDAPVGSGLWLCQPTPRCGNKIYNPSEQCCYDDAILSLKETRRCGSTCTFWPCFELCCPESFGPQQKFLVKLRVLGMKSQCHLSPISRSCTRNRRHVLYP

SEQ ID NO: 49606 - protein, 124 aa, Homo sapiens
MVPRISAAIFIFELLGSNSEGVTDLRLWLCQPAPRCGEWTYNPLEQCCDDGVILDLNQTRLCGSSCTFWPCFQHCCLESLGSQNQTVVRFKVPGMKPDCKSSPITRICAQEYHPKSPVSRSDLI

SEQ ID NO: 49607 - protein, 355 aa, Homo sapiens
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCRERPVPAKGHCPLTPGNPGAPSSQERSSPASSIAWRTPEPVPQQAWPNFLPLVVLVLLLTLAVIAILLFILLWHLCWPKEKADPYPYPGLVCGVPNTHTPSSSHLSSPGALETGDTWKEASLLPLLSRELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 49608 - protein, 167 aa, Homo sapiens
MGPGRCLLTALLLLALAPPPEASQYCGRLEYWNPDNKCCSSCLQRFGPPPCPELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 49609 - protein, 240 aa, Homo sapiens [sequence omitted]

SEQ ID NO: 49610 - protein, 557 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYEETELISTTANYRAVGPTAEADKSAAEKRRQLIQESKFLGGDMEHTHLVKGLDFALLQKVRAEIASKEKEEEELMEKPQKETKKDEDPENKIEFKTRLGRNVYRMLFKSKAYERNELFLPGRMAYVVDLDDEYADTDIPTTLIRSKADCPTMEAQTTLTTNDIVISKLTQILSYLRQGTRNKKLKKKDKGKLEEKKPPEADMNIFEDIGDYVPSTTKTPRDKERERYRERERDRERDRDRDRERERERDRERERERDREREEEKKRHSYFEKPKVDDEPMDVDKGPGSTKELIKSINEKFAGSAGWEGTESLKKPEDKKQLGDFFGMSNSYAECYPATMDDMAVDSDEEVDYSKMDQGNKKGPLGRWDFDTQEEYSEYMNNKEALPKAAFQYGIKMSEGRKTRRFKETNDKAELDRQWKKISAIIEKRKKMEADGVEVKRPKY

SEQ ID NO: 49611 - protein, 519 aa, Homo sapiens
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 49612 - protein, 432 aa, Homo sapiens
MDADEGQDMSQVSGKESPPVSDTPDEGDEPMPIPEDLSTTSGGQQSSKSDRVVGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 49613 - protein, 289 aa, Homo sapiens
MDADEGQDMSQVSGKESPPVSDTPDEGDEPMPIPEDLSTTSGGQQSSKSDRVVGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 49614 - protein, 376 aa, Homo sapiens
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 49615 - protein, 432 aa, Homo sapiens
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 49616 - protein, 477 aa, Homo sapiens
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 49617 - protein, 432 aa, Homo sapiens; identical to SEQ ID NO: 49612

SEQ ID NO: 49618 - protein, 477 aa, Homo sapiens; identical to SEQ ID NO: 49616

SEQ ID NO: 49619 - protein, 226 aa, Homo sapiens
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVIKEETNHSEMAEDLCKIGSEISRAGQTSK

SEQ ID NO: 49620 - protein, 585 aa, Homo sapiens
MHTPPALPRRFQGGGRVRTPGSHRQGKDNLERDPSGGCVPDFLPQAQDSNHFIMESLFCESSGDSSLEKEFLGAPVGPSVSTPNSQHSSPSRSLSANSIKVEMYSDEESSRLLGPDERLLEKDDSVIVEDSLSEPLGYCDGSGPEPHSPGGIRLPNGKLKCDVCGMVCIGPNVLMVHKRSHTGERPFHCNQCGASFTQKGNLLRHIKLHSGEKPFKCPFCNYACRRRDALTGHLRTHSVSSPTVGKPYKCNYCGRSYKQQSTLEEHKERCHNYLQSLSTEAQALAGQPGDEIRDLEMVPDSMLHSSSERPTFIDRLANSLTKRKRSTPQKFVGEKQMRFSLSDLPYDVNSGGYEKDVELVAHHSLEPGFGSSLAFVGAEHLRPLRLPPTNCISELTPVISSVYTQMQPLPGRLELPGSREAGEGPEDLADGGPLLYRPRGPLTDPGASPSNGCQDSTDTESNHEDRVAGVVSLPQGPPPQPPPTIVVGRHSPAYAKEDPKPQEGLLRGTPGPSKEVLRVVGESGEPVKAFKCEHCRILFLDHVMFTIHMGCHGFRDPFECNICGYHSQDRYEFSSHIVRGEHKVG

SEQ ID NO: 49621 - protein, 483 aa, Homo sapiens
MYSDEESSRLLGPDERLLEKDDSVIVEDSLSEPLGYCDGSGPEPHSPGGIRLPNGKLKCDVCGMVCIGPNVLMVHKRSHTGERPFHCNQCGASFTQKGNLLRHIKLHSGEKPFKCPFCNYACRRRDALTGHLRTHSVSSPTVGKPYKCNYCGRSYKQQSTLEEHKERCHNYLQSLSTEAQALAGQPGDEIRDLEMVPDSMLHSSSERPTFIDRLANSLTKRKRSTPQKFVGEKQMRFSLSDLPYDVNSGGYEKDVELVAHHSLEPGFGSSLAFVGAEHLRPLRLPPTNCISELTPVISSVYTQMQPLPGRLELPGSREAGEGPEDLADGGPLLYRPRGPLTDPGASPSNGCQDSTDTESNHEDRVAGVVSLPQGPPPQPPPTIVVGRHSPAYAKEDPKPQEGLLRGTPGPSKEVLRVVGESGEPVKAFKCEHCRILFLDHVMFTIHMGCHGFRDPFECNICGYHSQDRYEFSSHIVRGEHKVG

SEQ ID NO: 49622 - protein, 585 aa, Homo sapiens; identical to SEQ ID NO: 49620

SEQ ID NO: 49623 - protein, 10 aa, Homo sapiens
MHTPPALPRR

SEQ ID NO: 49624 - protein, 620 aa, Homo sapiens
MNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGHEGYVPSSYLVEKSPNNLETYEWYNKSISRDKAEKLLLDTGKEGAFMVRDSRTAGTYTVSVFTKAVVSENNPCIKHYHIKETNDNPKRYYVAEKYVFDSIPLLINYHQHNGGGLVTRLRYPVCFGRQKAPVTAGLRYGKWVIDPSELTFVQEIGSGQFGLVHLGYWLNKDKVAIKTIREGAMSEEDFIEEAEVMMKLSHPKLVQLYGVCLEQAPICLVFEFMEHGCLSDYLRTQRGLFAAETLLGMCLDVCEGMAYLEEACVIHRDLAARNCLVGENQVIKVSDFGMTRFVLDDQYTSSTGTKFPVKWASPEVFSFSRYSSKSDVWSFGVLMWEVFSEGKIPYENRSNSEVVEDISTGFRLYKPRLASTHVYQIMNHCWKERPEDRPAFSRLLRQLAEIAESGL

SEQ ID NO: 49625 - protein, 632 aa, Homo sapiens
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 49626 - protein, 225 aa, Homo sapiens
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPPPGCGQHPHWEDGLPRWLHCCIGPCGSGRLAAFLPLDCVQLVWSLIIACPGPIP

SEQ ID NO: 49627 - protein, 262 aa, Homo sapiens
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLP

SEQ ID NO: 49628 - protein, 166 aa, Homo sapiens
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQL

SEQ ID NO: 49629 - protein, 206 aa, Homo sapiens
MAATRCLRWGLSRAGVWLLPPPARCPRRALHKQKDGTEFKSIYSLDKLYPESQGSDTAWRVPNGAKQADSDIPLDRLTISYCRSSGPGGQNVNKVNSKAEVRFHLATAEWIAEPVRQKIAITHKNKINRLGELILTSESSRYQFRNLADCLQKIRDMITEASQTPKEPTKEDVKLHRIRIENMNRERLRQKRIHSAVKTSRRVDMD

SEQ ID NO: 49630 - protein, 156 aa, Homo sapiens
MCHSRSCHPTMTILQAPTPAPSTIPGPRRGSGPEIFTFDPLPEPAAAPAGRPSASRGHRKRSRRVLYPRVVRRQLPVEEPNPAKRLLFLLLTIVFCQILMAEEGVPAPLPPEDAPNAASLAPTPVSAVLEPFNLTSEPSDYALDLSTFLQQHPAAF

SEQ ID NO: 49631 - protein, 138 aa, Homo sapiens
MCHSRSCHPTMTILQAPTPAPSTIPGPRRGSGPEIFTFDPLPEPAAAPAGRPSASRGHRKRSRRVLYPRVVSIAEVGIRGVRCPGVTGERPDSRGLDLTCLLFCLPLGPAPAASRGTEPSQKASLSAAHHRLLPDPDG

SEQ ID NO: 49632 - protein, 192 aa, Homo sapiens
MCHSRSCHPTMTILQAPTPAPSTIPGPRRGSGPEIFTFDPLPEPAAAPAGRPSASRGHRKRSRRVLPSSGEYRRSGHSRGALPWSHWGTTRLQGLDLTCLLFCLPLVRRQLPVEEPNPAKRLLFLLLTIVFCQILMAEEGVPAPLPPEDAPNAASLAPTPVSAVLEPFNLTSEPSDYALDLSTFLQQHPAAF

SEQ ID NO: 49633 - protein, 156 aa, Homo sapiens
MCHSRSCHPTMTILQAPTPAPSTIPGPRRGSGPEIFTFDPLPEPAAAPAGRPSASRGHRKRSRRVLYPRVVRRQLPVEEPNPAKRLLFLLLTIVFCQILMAEEGVPAPLPPEDAPNAASLAPTPVSPVLEPFNLTSEPSDYALDLSTFLQQHPAAF

SEQ ID NO: 49634 - protein, 138 aa, Homo sapiens; identical to SEQ ID NO: 49631

SEQ ID NO: 49635 - protein, 138 aa, Homo sapiens; identical to SEQ ID NO: 49631

SEQ ID NO: 49636 - protein, 156 aa, Homo sapiens; identical to SEQ ID NO: 49633

SEQ ID NO: 49637 - protein, 138 aa, Homo sapiens; identical to SEQ ID NO: 49631

SEQ ID NO: 49638 - protein, 156 aa, Homo sapiens; identical to SEQ ID NO: 49633

SEQ ID NO: 49639 - protein, 138 aa, Homo sapiens; identical to SEQ ID NO: 49631

SEQ ID NO: 49640 - protein, 156 aa, Homo sapiens; identical to SEQ ID NO: 49633

SEQ ID NO: 49641 - protein, 138 aa, Homo sapiens; identical to SEQ ID NO: 49631

SEQ ID NO: 49642 - protein, 156 aa, Homo sapiens; identical to SEQ ID NO: 49633

SEQ ID NO: 49643 - protein, 82 aa, Homo sapiens
MAFTLYSLLQAALLCVNAIAVLHEERFLKNIGWGTDQGIGGFGEEPGIKSQLMNLIRSVRTVMRVPLIIVNSIAIVLLLLFG

SEQ ID NO: 49644 - protein, 327 aa, Homo sapiens
MEFKLEAHRIVSISLGKIYNSRVQRGGIKLHKNLLVSLVLRSARQVYLSDPCPGLYLAGPAGTPAPPPQQQPGEPAAGPPAGWGEPPPPAARASWPETEPQPERSSVSDAPRVGDEVPVATVTGVGDVFQGGEADATEAAWSRVEGPRQAAAREAEGTAGGWGVFPEVSRAARRPCGCPLGGEDPPGTPAATPRAACCCAPQPAEDEPPAPPAVCPRKRCAAGVGGGPAGCPAPGSTPLKKPRRNLEQPPSGGEDDDAEEMETGNVANLISIFGSSFSGLLRKSPGGGREEEEGEESGPEAAEPGQICCDKPVLRDMNPWSTAIVAF

SEQ ID NO: 49645 - protein, 139 aa, Homo sapiens
MEFKLEAHRIVSISLGKIYNSRVQRGGIKLHKNLLVSLVLRSARQVYLSDPCPGLYLAGPAGTPAPPPQQQPGEPAAGPPAGWGEPPPPAARASWPETEPQPERSSVSDAPRVGDEVPVATVTGVGDVFQGRSAAISRC

SEQ ID NO: 49646 - protein, 181 aa, Homo sapiens
MEAMNVEKASADGNLPEVISNIKETLKIVSRTPVNITMAGDSGNGMSTFISALRNTGHEGKASPPTELVKATQRCASYFSSHFSNVVLWDLPGTGSATTTLENYLMEMQFNRYDFIMVASAQFSMNHVMLAKTAEDMGKKFYIVWTKLDMDLSTGALPEVQLLQIRENVLENLQKERVCEY

SEQ ID NO: 49647 - protein, 339 aa, Homo sapiens
MAAEDELQLPRLPELFETGRQLLDEVEVATEPAGSRIVQEKVFKGLDLLEKAAEMLSQLDLFSRNEDLEEIASTDLKYLLVPAFQGALTMKQVNPSKRLDHLQRAREHFINYLTQCHCYHVAEFELPKTMNNSAENHTANSSMAYPSLVAMASQRQAKIQRYKQKKELEHRLSAMKSAVESGQADDERVREYYLLHLQRWIDISLEEIESIDQEIKILRERDSSREASTSNSSRQERPPVKPFILTRNMAQAKVFGAGYPSLPTMTVSDWYEQHRKYGALPDQGIAKAAPEEFRKAAQQQEEQEEKEEEDDEQTLHRAREWDDWKDTHPRGYGNRQNMG

SEQ ID NO: 49648 - protein, 339 aa, Homo sapiens; identical to SEQ ID NO: 49647

SEQ ID NO: 49649 - protein, 159 aa, Homo sapiens
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 49650 - protein, 70 aa, Homo sapiens
MKNHLLFWGVLAVFIKAVHVKAQEDERIVLVDNKCKCARITSRIIRSSEDPNEDIVERNIRIIVPLNNRE

SEQ ID NO: 49651 - protein, 159 aa, Homo sapiens; identical to SEQ ID NO: 49649

SEQ ID NO: 49652 - protein, 175 aa, Homo sapiens
MKNHLLFWGVLAVFIKAVHVKGSRDSSASASRVAGITAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 49653 - protein, 213 aa, Homo sapiens
MRPGTGQGGLEAPGEPGPNLRQRWPLLLLGLAVVTHGLLRPTAASQSRALGPGAPGGSSRSSLRSRWGRFLLQRGSWTGPRCWPRGFQSKHNSVTHVFGSGTQLTVLSQPKATPSVTLFPPSSEELQANKATLVCLMNDFYPGILTVTWKADGTPITQGVEMTTPSKQSNNKYAASSYLSLTPEQWRSRRSYSCQVMHEGSTVEKTVAPAECS

SEQ ID NO: 49654 - protein, 84 aa, Homo sapiens
MRPGTGQGGLEAPGEPGPNLRQRWPLLLLGLAVVTHGLLRPTAASQSRALGPGAPGGSSRSSLRSRWGRSAQGHPLGHSVPAVL

SEQ ID NO: 49655 - protein, 993 aa, Homo sapiens
MASAAVESFVTKQLDLLELERDAEVEERRSWQENISLKELQSRGVCLLKLQVSSQRTGLYGRLLVTFEPRRYGSAAALPSNSFTSGDIVGLYDAANEGSQLATGILTRVTQKSVTVAFDESHDFQLSLDRENSYRLLKLANDVTYRRLKKALIALKKYHSGPASSLIEVLFGRSAPSPASEIHPLTFFNTCLDTSQKEAVLFALSQKELAIIHGPPGTGKTTTVVEIILQAVKQGLKVLCCAPSNIAVDNLVERLALCKQRILRLGHPARLLESIQQHSLDAVLARSDSAQIVADIRKDIDQVFVKNKKTQDKREKSNFRNEIKLLRKELKEREEAAMLESLTSANVVLATNTGASADGPLKLLPESYFDVVVIDECAQALEASCWIPLLKARKCILAGDHKQLPPTTVSHKAALAGLSLSLMERLAEEYGARVVRTLTVQYRMHQAIMRWASDTMYLGQLTAHSSVARHLLRDLPGVAATEETGVPLLLVDTAGCGLFELEEEDEQSKGNPGEVRLVSLHIQALVDAGVPARDIAVVSPYNLQVDLLRQSLVHRHPELEIKSVDGFQGREKEAVILSFVRSNRKGEVGFLAEDRRINVAVTRARRHVAVICDSRTVNNHAFLKTLVEYFTQHGEVRTAFEYLDDIVPENYSHENSQGSSHAATKPQGPATSTRTGSQRQEGGQEAAAPARQGRKKPAGKSLASEAPSQPSLNGGSPEGVESQDGVDHFRAMIVEFMASKKMQLEFPPSLNSHDRLRVHQIAEEHGLRHDSSGEGKRRFITVSKRAPRPRAALGPPAGTGGPAPLQPVPPTPAQTEQPPREQRGPDQPDLRTLHLERLQRVRSAQGQPASKEQQASGQQKLPEKKKKKAKGHPATDLPTEEDFEALVSAAVKADNTCGFAKCTAGVTTLGQFCQLCSRRYCLSHHLPEIHGCGERARAHARQRISREGVLYAGSGTKNGSLDPAKRAQLQRRLDKKLSELSNQRTSRRKERGT

SEQ ID NO: 49656 - protein, 428 aa, Homo sapiens
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFDCTCGIVWLKTWALTTAVSIPEQDNIACTSPHVLKGTPLSRLPPLPCSAPSVQLSYQPSQDGAELRPGFVLALHCDVDGQPAPQLHWHIQIPSGIVEITSPNVGTDGRALPGTPVASSQPRFQAFANGSLLIPDFGKLEEGTYSCLATNELGSAESSVDVALATPGEGGEDTLGRRFHGKAVEGKGCYTVDNEVQPSGPEDNVVIIYLSRAGNPEAAVAEGVPGQLPPGLLLLGQSLLLFFFLTSF

SEQ ID NO: 49657 - protein, 428 aa, Homo sapiens; identical to SEQ ID NO: 49656

SEQ ID NO: 49658 - protein, 147 aa, Homo sapiens
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRA

SEQ ID NO: 49659 - protein, 183 aa, Homo sapiens
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFD

SEQ ID NO: 49660 - protein, 745 aa, Homo sapiens
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 49661 - protein, 334 aa, Homo sapiens
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 49662 - protein, 745 aa, Homo sapiens; identical to SEQ ID NO: 49660

SEQ ID NO: 49663 - protein, 745 aa, Homo sapiens; identical to SEQ ID NO: 49660

SEQ ID NO: 49664 - protein, 745 aa, Homo sapiens; identical to SEQ ID NO: 49660

SEQ ID NO: 49665 - protein, 745 aa, Homo sapiens; identical to SEQ ID NO: 49660

SEQ ID NO: 49666 - protein, 1336 aa, Homo sapiens
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 49667 - protein, 242 aa, Homo sapiens
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGGCGYGCWHLAIVVPGIMAG

SEQ ID NO: 49668 - protein, 242 aa, Homo sapiens; identical to SEQ ID NO: 49667

SEQ ID NO: 49669 - protein, 1341 aa, Homo sapiens
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCAISFAGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 49670 - protein, 1327 aa, Homo sapiens
MTLDRPGEGATMLKTFTVLLFCILMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 49671 - protein, 1327 aa, Homo sapiens; identical to SEQ ID NO: 49670

SEQ ID NO: 49672 - protein, 1214 aa, Homo sapiens
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLTDNWVVKVPQHHQLLSQGHLESSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 49673 - protein, 1214 aa, Homo sapiens; identical to SEQ ID NO: 49672

SEQ ID NO: 49674 - protein, 1194 aa, Homo sapiens
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLKSSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 49675 - protein, 241 aa, Homo sapiens
MGTASRSNIARHLQTNLILFCVGAVGACTLSVTQPWYLEVDYTHEAVTIKCTFSATGCPSEQPTCLWFRYGAHQPENLCLDGCKSEADKFTVREALKENQVSLTVNRVTSNDSAIYICGIAFPSVPEARAKQTGGGTTLVVREIKLLSKELRSFLTALVSLLSVYVTGVCVAFILLSKSKSNPLRNKEIKEDSQKKKSARRIFQEIAQELYHKRHVETNQQSEKDNNTYENRRVLSNYERP

SEQ ID NO: 49676 - protein, 613 aa, Homo sapiens
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 49677 - protein, 526 aa, Homo sapiens
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRSARSGPVTVYPYMHALDTLFVPLLVGTGVALVTGATVLGTITCCFMKRLRKR

SEQ ID NO: 49678 - protein, 613 aa, Homo sapiens; identical to SEQ ID NO: 49676

SEQ ID NO: 49679 - protein, 301 aa, Homo sapiens
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTL

SEQ ID NO: 49680 - protein, 717 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 49681 - protein, 1163 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLCMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 49682 - protein, 1179 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 49683 - protein, 1349 aa, Homo sapiens
MIWYVATFIASVIGTRGLAAEGAHGLREEPEFVTARAGESVVLRCDVIHPVTGQPPPYVVEWFKFGVPIPIFIKFGYYPPHVDPEYAGRASLHDKASLRLEQVRSEDQGWYECKVLMLDQQYDTFHNGSWVHLTINAPPTFTETPPQYIEAKEGGSITMTCTAFGNPKPIVTWLKEGTLLGASGKYQVSDGSLTVTSVSREDRGAYTCRAYSIQGEAVHTTHLLVQGPPFIVSPPENITVNISQDALLTCRAEAYPGNLTYTWYWQDENVYFQNDLKLRVRILIDGTLIIFRVKPEDSGKYTCVPSNSLGRSPSASAYLTVQYPARVLNMPPVIYVPVGIHGYIRCPVDAEPPATVVKWNKDGRPLQVEKNLGWTLMEDGSIRIEEATEEALGTYTCVPYNTLGTMGQSAPARLVLKDPPYFTVLPGWEYRQEAGRELLIPCAAAGDPFPVITWRKVGKPSRSKHSALPSGSLQFRALSKEDHGEWECVATNVVTSITASTHLTVIGTSPHAPGSVRVQVSMTTANVSWEPGYDGGYEQTFSVWMKRAQFGPHDWLSLPVPPGPSWLLVDTLEPETAYQFSVLAQNKLGTSAFSEVVTVNTLAFPITTPEPLVLVTPPRCLIANRTQQGVLLSWLPPANHSFPIDRYIMEFRVAERWELLDDGIPGTEGEFFAKDLSQDTWYEFRVLAVMQDLISEPSNIAGVSSTDIFPQPDLTEDGLARPVLAGIVATICFLAAAILFSTLAACFVNKQRKRKLKRKKDPPLSITHCRKSLESPLSSGKVSPESIRTLRAPSESSDDQGQPAAKRMLSPTREKELSLYKKTKRAISSKKYSVAKAEAEAEATTPIELISRGPDGRFVMDPAEMEPSLKSRRIEGFPFAEETDMYPEFRQSDEENEDPLVPTSVAALKSQLTPLSSSQESYLPPPAYSPRFQPRGLEGPGGLEGRLQATGQARPPAPRPFHHGQYYGYLSSSSPGEVEPPPFYVPEVGSPLSSVMSSPPLPTEGPFGHPTIPEENGENASNSTLPLTQTPTGGRSPEPWGRPEFPFGGLETPAMMFPHQLPPCDVPESLQPKAGLPRGLPPTSLQVPAAYPGILSLEAPKGWAGKSPGRGPVPAPPAAKWQDRPMQPLVSQGQLRHTSQGMGIPVLPYPEPAEPGAHGGPSTFGLDTRWYEPQPRPRPSPRQARRAEPSLHQVVLQPSRLSPLTQSPLSSRTGSPELAARARPRPGLLQQAEMSEITLQPPAAVSFSRKSTPSTGSPSQSSRSGSPSYRPAMGFTTLATGYPSPPPGPAPAGPGDSLDVFGQTPSPRRTGEELLRPETPPPTLPTSGKLQRDRPAPATSPPERALSKL

SEQ ID NO: 49684 - protein, 502 aa, Homo sapiens
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLHWLTVIFIILGALLLLLLIGVCWCQCCPQYCCCYIRCPCCPAHCCCPEEDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 49685 - protein, 546 aa, Homo sapiens
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLHWLTVIFIILGALLLLLLIGVCWCQCCPQYCCCYIRCPCCPAHCCCPEEALARHRYMKQAQALGPQMMGKPLYWGADRSSQVSSYPMHPLLQRDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 49686 - protein, 212 aa, Homo sapiens
MAWPKLPAPWLLLCTWLPAGCLSLLVTVQHTERYVTLFASIILKCDYTTSAQLQDVVVTWRFKSFCKDPIFDYYSASYQAALSLGQDPSNDCCCCPEEALARHRYMKQAQALGPQMMGKPLYWGADRSSQVSSYPMHPLLQRDLSLPSSLPQMPMTQTTNQPPIANGVLEYLEKELRNLNLAQPLPPDLKGRFGHPCSMLSSLGSENQIEEF

SEQ ID NO: 49687 - protein, 457 aa, Homo sapiens
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNPLARHRYMKQAQALGPQMMGKPLYWGADRSSQVSSYPMHPLLQRDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 49688 - protein, 514 aa, Homo sapiens
MAGNIFCPFALFFLPMSRVGHLQHFLLLLALGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLHWLTVIFIILGALLLLLLIGVCWCQCCPQYCCCYIRCPCCPAHCCCPEEDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 49689 - protein, 599 aa, Homo sapiens
MEGPLTPPPLQGGGAAAVPEPGARQHPGHETAAQRYSARLLQAGYEPESPRLDLATHPTTPRSELSSVVLLAGVGVQMDRLRRASMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 49690 - protein, 489 aa, Homo sapiens
MADYLISGGTGYVPEDGLTAQQLFASADGLTYNDFLILPGFIDFIADEVDLTSALTRKITLKTPLISSPMDTVTEADMAIAMAKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 49691 - protein, 563 aa, Homo sapiens
MEGPLTPPPLQGGGAAAVPEPGARQHPGHETAAQRYSARLLQAGYEPESMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 49692 - protein, 589 aa, Homo sapiens
MEGPLTPPPLQGGGAAAVPEPGARQHPGHETAAQRYSARLLQAGYEPESCFLLELSSVVLLAGVGVQMDRLRRASMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 49693 - protein, 530 aa, Homo sapiens
MEGPLTPPPLQGGGAAAVPEPGARQHPGHETAAQRYSARLLQAGYEPESDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 49694 - protein, 566 aa, Homo sapiens
MEGPLTPPPLQGGGAAAVPEPGARQHPGHETAAQRYSARLLQAGYEPESPRLDLATHPTTPRSELSSVVLLAGVGVQMDRLRRASDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 49695 - protein, 509 aa, Homo sapiens
MADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 49696 - protein, 489 aa, Homo sapiens; identical to SEQ ID NO: 49690

SEQ ID NO: 49697 - protein, 514 aa, Homo sapiens
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 49698 - protein, 357 aa, Homo sapiens
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVCTQKQHPHFQ

SEQ ID NO: 49699 - protein, 166 aa, Homo sapiens
MLRGVLGKTFRLVGYTIQYGCIAHCAFEYVGGVVMCSGPSMEPTIQNSDIVFAENLSRHFYGIQRGDIVIAKSPSDPKSNICKRVIGLEGDKILTTSPSDFFKSHSYVPMGHVWLEGDNLQNSTDSRCYGPIPYGLIRGRIFFKIWPLSDFGFLRASPNGHRFSDD

SEQ ID NO: 49700 - protein, 107 aa, Homo sapiens
MLRGVLGKTFRLVGYTIQYGCIAHCAFEYVGGVVMCSGPSMEPTIQNSDIVFAENLSRHFYGIQRGDIVIAKSPSDPKSNICKRVIGLEGDKILTTSPSDFFKSHSY

SEQ ID NO: 49701 - protein, 96 aa, Homo sapiens
MLRGVLGKTFRLVGYTIQYGCIAHCAFEYVGGVVMCSGPSMEPTIQNSDIVFAENLSRHFYGIQRGDIVIAKSPSDPKSNICKRVIGLEGDKILTT

SEQ ID NO: 49702 - protein, 166 aa, Homo sapiens; identical to SEQ ID NO: 49699

SEQ ID NO: 49703 - protein, 175 aa, Homo sapiens
MAQSQGWVKRYIKAFCKGFFVAVPVAVTFLDRVACVARVEGASMQPSLNPGGSQSSDVVLLNHWKVRNFEVHRGDIVSLVSPKNPEQKIIKRVIALEGDIVRTIGHKNRYVKVPRGHIWVEGDHHGHSFDSNSFGPVSLGLLHAHATHILWPPERWQKLESVLPPERLPVQREEE

SEQ ID NO: 49704 - protein, 175 aa, Homo sapiens; identical to SEQ ID NO: 49703

SEQ ID NO: 49705 - protein, 175 aa, Homo sapiens; identical to SEQ ID NO: 49703

SEQ ID NO: 49706 - protein, 110 aa, Homo sapiens
MAQSQGWVKRYIKAFCKGFFVAVPVAVTFLDRVACVARVEGASMQPSLNPGGSQSSDVVLLNHWKVRNFEVHRGDIVSLVSPKNPEQKIIKRVIALEGDIVRDGRKLKRI

SEQ ID NO: 49707 - protein, 79 aa, Homo sapiens
MAQSQGWVKRYIKAFCKGFFVAVPVAVTFLDRVACVARVEGASMQPSLNPGGSQSSDVVLLNHWKVRNFEVHRGDIVSL

SEQ ID NO: 49708 - protein, 175 aa, Homo sapiens; identical to SEQ ID NO: 49703

SEQ ID NO: 49709 - protein, 184 aa, Homo sapiens
MVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTVLLKLRMAQHLQAAVAFVEQGHVRVGPDVVTDPAFLVTRSMEDFVTWVDSSKIKRHVLEYNEERDDFDLEA

SEQ ID NO: 49710 - protein, 184 aa, Homo sapiens; identical to SEQ ID NO: 49709

SEQ ID NO: 49711 - protein, 31 aa, Homo sapiens [sequence omitted]

SEQ ID NO: 49712 - protein, 291 aa, Homo sapiens
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 49713 - protein, 975 aa, Homo sapiens
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECSRSIGTDNVCRDRLEKTIILFTKVLLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 49714 - protein, 1015 aa, Homo sapiens
MVQPIIHLGYVVYSLLYLGYKPVQHVTALNTVSSCHKMVSMDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECSRSIGTDNVCRDRLEKTIILFTKVLLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 49715 - protein, 64 aa, Homo sapiens
MDLNSASTVVLQVLTQATSQDTAVLKPAEEQLKQWETQPGFYSVLLNIFTNHTLDINVRWLAVL

SEQ ID NO: 49716 - protein, 162 aa, Homo sapiens
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKR

SEQ ID NO: 49717 - protein, 149 aa, Homo sapiens
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALL

SEQ ID NO: 49718 - protein, 474 aa, Homo sapiens
MMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDCMLMSHLEEPK

SEQ ID NO: 49719 - protein, 1038 aa, Homo sapiens
MDPNTIIEALRGTMDPALREAAERQLNEAHKSLNFVSTLLQITMSEQLDLPVRQAGVIYLKNMITQYWPDRETAPGDISPYTIPEEDRHCIRENIVEAIIHSPELIRVQLTTCIHHIIKHDYPSRWTAIVDKIGFYLQSDNSACWLGILLCLYQLVKNYEYKKPEERSPLVAAMQHFLPVLKDRFIQLLSDQSDQSVLIQKQIFKIFYALVQYTLPLELINQQNLTEWIEILKTVVNRDVPNETLQVEEDDRPELPWWKCKKWALHILARLFERYGSPGNVSKEYNEFAEVFLKAFAVGVQQVLLKVLYQYKEKQYMAPRVLQQTLNYINQGVSHALTWKNLKPHIQGIIQDVIFPLMCYTDADEELWQEDPYEYIRMKFDVFEDFISPTTAAQTLLFTACSKRKEVLQKTMGFCYQILTEPNADPRKKDGALHMIGSLAEILLKKKIYKDQMEYMLQNHVFPLFSSELGYMRARACWVLHYFCEVKFKSDQNLQTALELTRRCLIDDREMPVKVEAAIALQVLISNQEKAKEYITPFIRPVMQALLHIIRETENDDLTNVIQKMICEYSEEVTPIAVEMTQHLAMTFNQVIQTGPDEEGSDDKAVTAMGILNTIDTLLSVVEDHKEITQQLEGICLQVIGTVLQQHVLEFYEEIFSLAHSLTCQQVSPQMWQLLPLVFEVFQQDGFDYFTDMMPLLHNYVTVDTDTLLSDTKYLEMIYSMCKKVLTGVAGEDAECHAAKLLEVIILQCKGRGIDQCIPLFVEAALERLTREVKTSELRTMCLQVAIAALYYNPHLLLNTLENLRFPNNVEPVTNHFITQWLNDVDCFLGLHDRKMCVLGLCALIDMEQIPQVLNQVSGQILPAFILLFNGLKRAYACHAEHENDSDDDDEAEDDDETEELGSDEDDIDEDGQEYLEILAKQAGEDGDDEDWEEDDAEETALEGYSTIIDDEDNPVDEYQIFKAIFQTIQNRNPVWYQALTHGLNEEQRKQLQDIATLADQRRAAHESKMIEKHGGYKFSAPVVPSSFNFGGPAPGMN

SEQ ID NO: 49720 - protein, 1037 aa, Homo sapiens
MDLNRIIQALKGTIDPKLRIAAENELNQSYKIINFAPSLLRIIVSDHVEFPVRQAAAIYLKNMVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALVQYALPLQLVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAEAKKKIEQQGGFTFENKGVLSAFNFGTVPSNN

SEQ ID NO: 49721 - protein, 832 aa, Homo sapiens
MESLTLKGYALPLQLVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAEAKKKIEQQGGFTFENKGVLSAFNFGTVPSNN

SEQ ID NO: 49722 - protein, 513 aa, Homo sapiens
LSSGHELAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAEAKKKIEQQGGFTFENKGVLSAFNFGTVPSNN

SEQ ID NO: 49723 - protein, 1181 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPAWVTEQDSVSKKKKNHEG

SEQ ID NO: 49724 - protein, 199 aa, Homo sapiens
MVQGGFPEKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYG

SEQ ID NO: 49725 - protein, 1581 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLFWRLGSPRAWSQHLVRAFMLHHPVTEVEGQNAIVIHEVYEEGAAARDGRLWAGDQILEVNGVDLRNSSHEEAITALRQTPQKVRLVVYRDEAHYRDEENLEIFPVDLQKKAGRGLGLSIVGK

SEQ ID NO: 49726 - protein, 1801 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQGSQQSAHSSCHPSFAPVITGLQNLVGTKRVSDPSQKNSGTDMEPRTVEINRELSDALGISIAGGRGSPLGDIPVFIAMIQASGVAARTQKLKVGDRIVSINGQPLDGLSHADVVNLLKNAYGRIILQVVADTNISAIAAQLENMSTGYHLGSPTAEHHPEDTEEQLQMTAD

SEQ ID NO: 49727 - protein, 1523 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREILVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLVNGVDLRNSSHEEAITALRQTPQKVRLVVYRDEAHYRDEENLEIFPVDLQKKAGRGLGLSIVGK

SEQ ID NO: 49728 - protein, 452 aa, Homo sapiens
MVQGGFPEKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLFWRLGSPRAWSQHLVRAFMLHHPVTEVEGQNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQVVDGFSSD

SEQ ID NO: 49729 - protein, 197 aa, Homo sapiens [sequence omitted]

SEQ ID NO: 49730 - protein, 411 aa, Homo sapiens
MSPARLRPRLHFCLVLLLLLVVPAAWGCGPGRVVGSRRRPPRKLVPLAYKQFSPNVPEKTLGASGRYEGKIARSSERFKELTPNYNPDIIFKDEENTGADRLMTQRCKDRLNSLAISVMNQWPGVKLRVTEGWDEDGHHSEESLHYEGRAVDITTSDRDRNKYGLLARLAVEAGFDWVYYESKAHVHCSVKSEHSAAAKTGGCFPAGAQVRLESGARVALSAVRPGDRVLAMGEDGSPTFSDVLIFLDREPHRLRAFQVIETQDPPRRLALTPAHLLFTADNHTEPAARFRATFASHVQPGQYVLVAGVPGLQPARVAAVSTHVALGAYAPLTKHGTLVVEDVVASCFAAVADHHLAQLAFWPLRLFHSLAWGSWTPGEGVHWYPQLLYRLGRLLLEEGSFHPLGMSGAGS

SEQ ID NO: 49731 - protein, 403 aa, Homo sapiens [sequence omitted]

SEQ ID NO: 49732 - protein, 78 aa, Homo sapiens
MAHAMENSWTISKEYHIDEEVGFALPNPQENLPDFYNDWMFIAKHLPDLIESGQLRERVEKLNMLSIDHLTDHKSQRL

SEQ ID NO: 49733 - protein, 180 aa, Homo sapiens
MAHAMENSWTISKEYHIDEEVGFALPNPQENLPDFYNDWMFIAKHLPDLIESGQLRERVEKLNMLSIDHLTDHKSQRLARLVLGCITMAYVWGKGHGDVRKVLPRNIAVPYCQLSKKLELPPILVYADCVLANWKKKDPNKPLTYENMDVLFSFRDGDCSKGFFLVSLLVEIAAASAIKV

SEQ ID NO: 49734 - protein, 403 aa, Homo sapiens [sequence omitted]

SEQ ID NO: 49735 - protein, 47 aa, Homo sapiens
MAHAMENSWTISKEYHIDEEVGFALPNPQENLPDFYNDWMFIAKHLP

SEQ ID NO: 49736 - protein, 407 aa, Homo sapiens
MEPHRPNVKTAVPLSLESYHISEEYGFLLPDSLKELPDHYRPWMEIANKLPQLIDAHQLQAHVDKMPLLSCQFLKGHREQRLAHLVLSFLTMGYVWQEGEAQPAEVLPRNLALPFVEVSRNLGLPPILVHSDLVLTNWTKKDPDGFLEIGNLETIISFPGGESLHGFILVTALVEKEAVPGIKALVQATNAILQPNQEALLQALQRLRLSIQDITKTLGQMHDYVDPDIFYAGIRIFLSGWKDNPAMPAGLMYEGVSQEPLKYSGGSAAQSTVLHAFDEFLGIRHSKESGDFLYRMRDYMPPSHKAFIEDIHSAPSLRDYILSSGQDHLLTAYNQCVQALAELRSYHITMVTKYLITAAAKAKHGKPNHLPGPPQALKDRGTGGTAVMSFLKSVRDKTLESILHPRG

SEQ ID NO: 49737 - protein, 420 aa, Homo sapiens
MLHFHYYDTSNKIMEPHRPNVKTAVPLSLESYHISEEYGFLLPDSLKELPDHYRPWMEIANKLPQLIDAHQLQAHVDKMPLLSCQFLKGHREQRLAHLVLSFLTMGYVWQEGEAQPAEVLPRNLALPFVEVSRNLGLPPILVHSDLVLTNWTKKDPDGFLEIGNLETIISFPGGESLHGFILVTALVEKEAVPGIKALVQATNAILQPNQEALLQALQRLRLSIQDITKTLGQMHDYVDPDIFYAGIRIFLSGWKDNPAMPAGLMYEGVSQEPLKYSGGSAAQSTVLHAFDEFLGIRHSKESGDFLYRMRDYMPPSHKAFIEDIHSAPSLRDYILSSGQDHLLTAYNQCVQALAELRSYHITMVTKYLITAAAKAKHGKPNHLPGPPQALKDRGTGGTAVMSFLKSVRDKTLESILHPRG

SEQ ID NO: 49738 - protein, 263 aa, Homo sapiens
MKGGFTGGDEYQKHFLPRDYLATYYSFDGSPSPEAEMLKFNLECLHKTFGPGGLQGDTLIDIGSGPTIYQVLAACDSFQDITLSDFTDRNREELEKWLKKEPGAYDWTPAVKFACELEGNSGRWEEKEEKLRAAVKRVLKCDVHLGNPLAPAVLPLADCVLTLLAMECACCSLDAYRAALCNLASLLKPGGHLVTTVTLRLPSYMVGKREFSCVALEKEEVEQAVLDAGFDIEQLLHSPQSYSVTNAANNGVCFIVARKKPGP

SEQ ID NO: 49739 - protein, 262 aa, Homo sapiens
MKGGFTGGDEYQKHFLPRDYLATYYSFDGSPSPEAEMLKFNLECLHKTFGPGLQGDTLIDIGSGPTIYQVLAACDSFQDITLSDFTDRNREELEKWLKKEPGAYDWTPAVKFACELEGNSGRWEEKEEKLRAAVKRVLKCDVHLGNPLAPAVLPLADCVLTLLAMECACCSLDAYRAALCNLASLLKPGGHLVTTVTLRLPSYMVGKREFSCVALEKEEVEQAVLDAGFDIEQLLHSPQSYSVTNAANNGVCFIVARKKPGP

SEQ ID NO: 49740 - protein, 199 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 49741 - protein, 168 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKM

SEQ ID NO: 49742 - protein, 309 aa, Homo sapiens
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTESWNLLLLLS

SEQ ID NO: 49743 - protein, 185 aa, Homo sapiens
MRLGSPGLLFLLFSSLRAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 49744 - protein, 302 aa, Homo sapiens
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 49745 - protein, 366 aa, Homo sapiens
MVLHLLLFLLLTPQGGHSCQGLELARELVLAKVRALFLDALGPPAVTREGGDPGVRRLPRRHALGGFTHRGSEPEEEEDVSQAILFPATDASCEDKSAARGLAQEAEEGLFRYMFRPSQHTRSRQVTSAQLWFHTGLDRQGTAASNSSEPLLGLLALSPGGPVAVPMSLGHAPPHWAVLHLATSALSLLTHPVLVLLLRCPLCTCSARPEATPFLVAHTRTRPPSGGERARRSTPLMSWPWSPSALRLLQRPPEEPAAHANCHRVALNISFQELGWERWIVYPPSFIFHYCHGGCGLHIPPNLSLPVPGAPPTPAQPYSLLPGAQPCCAALPGTMRPLHVRTTSDGGYSFKYETVPNLLTQHCACI

SEQ ID NO: 49746 - protein, 426 aa, Homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 49747 - protein, 426 aa, Homo sapiens; identical to SEQ ID NO: 49746

SEQ ID NO: 49748 - protein, 407 aa, Homo sapiens
MDGLPGRALGAACLLLLAAGWLGPEAWGSPTPPPTPAAPPPPPPPGSPGGSQDTCTSCGGFRRPEELGRVDGDFLEAVKRHILSRLQMRGRPNITHAVPKAAMVTALRKLHAGKVREDGRVEIPHLDGHASPGADGQERVSEIISFAETDGLASSRVRLYFFISNEGNQNLFVVQASLWLYLKLLPYVLEKGSRRKVRVKVYFQEQGHGDRWNMVEKRVDLKRSGWHTFPLTEAIQALFERGERRLNLDVQCDSCQELAVVPVFVDPGEESHRPFVVVQARLGDSRHRIRKRGLECDGRTNLCCRQQFFIDFRLIGWNDWIIAPTGYYGNYCEGSCPAYLAGVPGSASSFHTAVVNQYRMRGLNPGTVNSCCIPTKLSTMSMLYFDDEYNIVKRDVPNMIVEECGCA

SEQ ID NO: 49749 - protein, 352 aa, Homo sapiens
MTSSLLLAFLLLAPTTVATPRAGGQCPACGGPTLELESQRELLLDLAKRSILDKLHLTQRPTLNRPVSRAALRTALQHLHGVPQGALLEDNREQECEIISFAETGLSTINQTRLDFHFSSDRTAGDREVQQASLMFFVQLPSNTTWTLKVRVLVLGPHNTNLTLATQYLLEVDASGWHQLPLGPEAQAACSQGHLTLELVLEGQVAQSSVILGGAAHRPFVAARVRVGGKHQIHRRGIDCQGGSRMCCRQEFFVDFREIGWHDWIIQPEGYAMNFCIGQCPLHIAGMPGIAASFHTAVLNLLKANTAAGTTGGGSCCVPTARRPLSLLYYDRDSNIVKTDIPDMVVEACGCS

SEQ ID NO: 49750 - protein, 350 aa, Homo sapiens
MRLPDVQLWLVLLWALVRAQGTGSVCPSCGGSKLAPQAERALVLELAKQQILDGLHLTSRPRITHPPPQAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLDHNGNVVKTDVPDMVVEACGCS

SEQ ID NO: 49751 - protein, 1353 aa, Homo sapiens
MSSPMPDCTSKCRSLKHALDVLSVVTKGSENQIKAFLSSHCYNAATIKDVFGRNALHLVSSCGKKGVLDWLIQKGVDLLVKDKESGWTALHRSIFYGHIDCVWSLLKHGVSLYIQDKEGLSALDLVMKDRPTHVVFKNTDPTDVYTWGDNTNFTLGHGSQNSKHHPELVDLFSRSGIYIKQVVLCKFHSVFLSQKGQVYTCGHGPGGRLGHGDEQTCLVPRLVEGLNGHNCSQVAAAKDHTVVLTEDGCVYTFGLNIFHQLGIIPPPSSCNVPRQIQAKYLKGRTIIGVAAGRFHTVLWTREAVYTMGLNGGQLGCLLDPNGEKCVTAPRQVSALHHKDIALSLVAASDGATVCVTTRGDIYLLADYQCKKMASKQLNLKKVLVSGGHMEYKVDPEHLKENGGQKICILAMDGAGRVFCWRSVNSSLKQCRWAYPRQVFISDIALNRNEILFVTQDGEGFRGRWFEEKRKSSEKKEILSNLHNSSSDVSYVSDINSVYERIRLEKLTFAHRAVSVSTDPSGCNFAILQSDPKTSLYEIPAVSSSSFFEEFGKLLREADEMDSIHDVTFQVGNRLFPAHKYILAVHSDFFQKLFLSDGNTSEFTDIYQKDEDSAGCHLFVVEKVHPDMFEYLLQFIYTDTCDFLTHGFKPRIHLNKNPEEYQGTLNSHLNKVNFHEDDNQKSAFEVYKSNQAQTVSERQKSKPKSCKKGKNIREDDPVRMLQTVAKKFDFSNLSSRLDGVRFENEKINVIAKNTGNKLKLSQKKCSFLCDVTMKSVDGKEFPCHKCVLCARLEYFHSMLSSSWIEASSCAALEMPIHSDILKVILDYLYTDEAVVIKESQNVDFICSVLVVADQLLITRLKEICEVALTEKLTLKNAAMLLEFAAMYSAKQLKLSCLQFIGLNMAALLEARSLDVLSDGVLKDLSEFYRKMIPAMDRRVITPYQDGPDISYLEVEDGDIFLKEEINMEQNHSETMFKKAKTKAKKKPRKRSDSSGGYNLSDIIQSPSSTGLLKSGKTNSVESLPELLTSDSEGSYAGVGSPRDLQSPDFTTGFHSDKIEAKVKPYVNGTSPVYSREDLKPWEKSPILKISAPQPIPSNRIDTTSSASWVAGSFSPVSPPVVDLRTIMEIEESRQKCGATPKSHLGKTVSHGVKLSQKQRKMIALTTKENNSGMNSMETVLFTPSKAPKPVNAWASSLHSVSSKSFRDFLLEEKKSVTSHSSGDHVKKVSFKGIENSQAPKIVRCSTHGTPGPEGNHISDLPLLDSPNPWLSSSVTAPSMVAPVTFASIVEEELQQEAALIRSREKPLALIQIEEHAIQDLLVFYEAFGNPEEFVIVERTPQGPLAVPMWNKHGC

SEQ ID NO: 49752 - protein, 134 aa, Homo sapiens
MKAFSPVRSVRKNSLSDHSLGISRSKTPVDDPMSLLYNMNDCYSKLKELVPSIPQNKKVSKMEILQHVIDYILDLQIALDSHPTIVSLHHQRPGQNQASRTPLTTLNTDISILSLQASEFPSELMSNDSKALCG

SEQ ID NO: 49753 - protein, 134 aa, Homo sapiens; identical to SEQ ID NO: 49752

SEQ ID NO: 49754 - protein, 134 aa, Homo sapiens; identical to SEQ ID NO: 49752

SEQ ID NO: 49755 - protein, 119 aa, Homo sapiens
MKALSPVRGCYEAVCCLSERSLAIARGRGKGPAAEEPLSLLDDMNHCYSRLRELVPGVPRGTQLSQVEILQRVIDYILDLQVVLAEPAPGPPDGPHLPIQTAELTPELVISNDKRSFCH

SEQ ID NO: 49756 - protein, 161 aa, Homo sapiens
MKAVSPVRPSGRKAPSGCGGGELALRCLAEHGHSLGGSAAAAAAAAAARCKAAEAAADEPALCLQCDMNDCYSRLRRLVPTIPPNKKVSKVEILQHVIDYILDLQLALETHPALLRQPPPPAPPHHPAGTCPAAPPRTPLTALNTDPAGAVNKQGDSILCR

SEQ ID NO: 49757 - protein, 280 aa, Homo sapiens
MLGQQQQQLYSSAALLTGERSRLLTCYVQDYLECVESLPHDMQRNVSVLRELDNKYQETLKEIDDVYEKYKKEDDLNQKKRLQQLLQRALINSQELGDEKIQIVTQMLELVENRARQMELHSQCFQDPAESERASDKAKMDSSQPERSSRRPRRQRTSESRDLCHMANGIEDCDDQPPKEKKSKSAKKKKRSKAKQEREASPVEFAIDPNEPTYCLCNQVSYGEMIGCDNEQCPIEWFHFSCVSLTYKPKGKWYCPKCRGDNEKTMDKSTEKTKKDRRSR

SEQ ID NO: 49758 - protein, 240 aa, Homo sapiens
MDQDGDQQLGPSRILAPQTLKEIDDVYEKYKKEDDLNQKKRLQQLLQRALINSQELGDEKIQIVTQMLELVENRARQMELHSQCFQDPAESERASDKAKMDSSQPERSSRRPRRQRTSESRDLCHMANGIEDCDDQPPKEKKSKSAKKKKRSKAKQEREASPVEFAIDPNEPTYCLCNQVSYGEMIGCDNEQCPIEWFHFSCVSLTYKPKGKWYCPKCRGDNEKTMDKSTEKTKKDRRSR

SEQ ID NO: 49759 - protein, 418 aa, Homo sapiens
MLYLEDYLEMIEQLPMDLRDRFTEMREMDLQVQNAMDQLEQRVSEFFMNAKKNKPEWREEQMASIKKDYYKALEDADEKVQLANQIYDLVDRHLRKLDQELAKFKMELEADNAGITEILERRSLELDTPSQPVNNHHAHSHTPVEKRKYNPTSHHTTTDHIPEKKFKSEALLSTLTSDASKENTLGCRNNNSTASSNNAYNVNSSQPLGSYNIGSLSSGTGAGAITMAAAQAVQATAQMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVSYGEMVGCDNQDCPIEWFHYGCVGLTEAPKGKWYCPQCTAAMKRRGSRHK

SEQ ID NO: 49760 - protein, 92 aa, Homo sapiens
MLYLEDYLEMIEQLPMDLRDRFTEMREMDLQVQNAMDQLEQRVSEFFMNAKKNKPEWREEQMASIKKDYYKALEDADEKVQLANQIYDLQHF

SEQ ID NO: 49761 - protein, 240 aa, Homo sapiens
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGGRGLKKGRGQKEKRGSRGRGRRTSEEDTPKKKKHKGGSEFTDTILSVHPSDVLDMPVDPNEPTYCLCHQVSYGEMIGCDNPDCPIEWFHFACVDLTTKPKGKWFCPRCVQEKRKKK

SEQ ID NO: 49762 - protein, 226 aa, Homo sapiens
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGGRGLKKGRGQKEKRGSRGRGRRTSEEDTPKKKKHKGGSEFTDTILSVHPSDVLDMPVDPNEPTYCLCHQVSYGEMIGCDNPDCPIEWFHFACVDLTTKPKGK

SEQ ID NO: 49763 - protein, 754 aa, Homo sapiens
MFSGGCHSPGFGRPSPAFPAPGSPPPAPRPCRQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 49764 - protein, 320 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRRKLAQLQVAYHQLFQEYDNHIKSSVVGSERKRADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 49765 - protein, 533 aa, Homo sapiens
MSSDGTIRHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 49766 - protein, 697 aa, Homo sapiens
MSSDGTIRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 49767 - protein, 756 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 49768 - protein, 1332 aa, Homo sapiens
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 49769 - protein, 983 aa, Homo sapiens
MWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 49770 - protein, 716 aa, Homo sapiens
MQSTANYLWHTDDLLGQGATASVYKARNKKSGELVAVKVFNTTSYLRPREVQVREFEVLRKLNHQNIVKLFAVEETGGSRQKVLVMEYCSSGSLLSVLESPENAFGLPEDEFLVVLRCVVAGMNHLRENGIVHRDIKPGNIMRLVGEEGQSIYKLTDFGAARELDDDEKFVSVYGTEEYLHPDMYERAVLRKPQQKAFGVTVDLWSIGVTLYHAATGSLPFIPFGGPRRNKEIMYRITTEKPAGAIAGAQRRENGPLEWSYTLPITCQLSLGLQSQLVPILANILEVEQAKCWGFDQFFAETSDILQRVVVHVFSLSQAVLHHIYIHAHNTIAIFQEAVHKQTSVAPRHQEYLFEGHLCVLEPSVSAQHIAHTTASSPLTLFSTAIPKGLAFRDPALDVPKFVPKVDLQADYNTAKGVLGAGYQALRLARALLDGQELMFRGLHWVMEVLQATCRRTLEVARTSLLYLSSSLGTERFSSVAGTPEIQELKAAAELRSRLRTLAEVLSRCSQNITETQESLSSLNRELVKSRDQVHEDRSIQQIQCCLDKMNFIYKQFKKSRMRPGLGYNEEQIHKLDKVNFSHLAKRLLQVFQEECVQKYQASLVTHGKRMRVVHETRNHLRLVGCSVAACNTEAQGVQESLSKLLEELSHQLLQDRAKGAQASPPPIAPYPSPTRKDLLLHMQELCEGMKLLASDLLDNNRIIERLNRVPAPPDV

SEQ ID NO: 49771 - protein, 631 aa, Homo sapiens
MEYCSSGSLLSVLESPENAFGLPEDEFLVVLRCVVAGMNHLRENGIVHRDIKPGNIMRLVGEEGQSIYKLTDFGAARELDDDEKFVSVYGTEEYLHPDMYERAVLRKPQQKAFGVTVDLWSIGVTLYHAATGSLPFIPFGGPRRNKEIMYRITTEKPAGAIAGAQRRENGPLEWSYTLPITCQLSLGLQSQLVPILANILEVEQAKCWGFDQFFAETSDILQRVVVHVFSLSQAVLHHIYIHAHNTIAIFQEAVHKQTSVAPRHQEYLFEGHLCVLEPSVSAQHIAHTTASSPLTLFSTAIPKGLAFRDPALDVPKFVPKVDLQADYNTAKGVLGAGYQALRLARALLDGQELMFRGLHWVMEVLQATCRRTLEVARTSLLYLSSSLGTERFSSVAGTPEIQELKAAAELRSRLRTLAEVLSRCSQNITETQESLSSLNRELVKSRDQVHEDRSIQQIQCCLDKMNFIYKQFKKSRMRPGLGYNEEQIHKLDKVNFSHLAKRLLQVFQEECVQKYQASLVTHGKRMRVVHETRNHLRLVGCSVAACNTEAQGVQESLSKLLEELSHQLLQDRAKGAQASPPPIAPYPSPTRKDLLLHMQELCEGMKLLASDLLDNNRIIERLNRVPAPPDV

SEQ ID NO: 49772 - protein, 368 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 49773 - protein, 419 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 49774 - protein, 419 aa, Homo sapiens; identical to SEQ ID NO: 49773

SEQ ID NO: 49775 - protein, 419 aa, Homo sapiens; identical to SEQ ID NO: 49773

SEQ ID NO: 49776 - protein, 487 aa, Homo sapiens
MALVIQVGKLRPREVRTPQTINPSLFPSLPVKLSSIIEVPSGGERCCSRRTLVYKARAFWKGAPLPCWMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 49777 - protein, 206 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQG

SEQ ID NO: 49778 - protein, 251 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVG

SEQ ID NO: 49779 - protein, 138 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAED

SEQ ID NO: 49780 - protein, 418 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 49781 - protein, 726 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAPTEAAQIISAAGDTLSVPAPAVQPEESLKTDHPEIGEGKPTPALSALAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSEYNLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 49782 - protein, 372 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEASSSSIRERPPEEVAARLAQQEKQEQVKIESLAKSLEDALRQTASVTLQAIAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 49783 - protein, 659 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATALAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 49784 - protein, 758 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAPTEAAQIISAAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 49785 - protein, 757 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAPTEAAQIISAAGDTLSVPAPAVQPEESLKTDHPEIGEGKPTPALSEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 49786 - protein, 747 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSVSDLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 49787 - protein, 747 aa, Homo sapiens
MLRACQLSGVTAAAQSCLCGKFVLRPLRPCRRYSTSGSSGLTTGKIAGAGLLFVGGGIGGTILYAKWDSHFRESVEKTIPYSDKLFEMVLGPAAYNVPLPKKSIQSGPLKISSVSEVMKESKQPASQLQKQKGDTPASATAGDTLSVPAPAVQPEESLKTDHPEIGEGKPTPALSEEASSSSIRERPPEEVAARLAQQEKQEQVKIESLAKSLEDALRQTASVTLQAIAAQNAAVQAVNAHSNILKAAMDNSEIAGEKKSAQWRTVEGALKERRKAVDEAADALLKAKEELEKMKSVIENAKKKEVAGAKPHITAAEGKLHNMIVDLDNVVKKVQAAQSEAKVVSQYHELVVQARDDFKRELDSITPEVLPGWKGMSEYNLADKLSTDDLNSLIAHAHRRIDQLNRELAEQKATEKQHITLALEKQKLEEKRAFDSAVAKALEHHRSEIQAEQDRKIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 49788 - protein, 192 aa, Homo sapiens
MDRAHRLGQTKQVTVYRLICKGTIEERILQRAKEKSEIQRMVISGGNFKPDTLKPKEVVSLLLDDEELEKKLRLRQEEKRQQEETNRVKERKRKREKYAEKKKKEDELDGKRRKEGVNLVIPFVPSADNSNLSADGDDSFISVDSAMPSPFSEISISSELHTGSIPLDESSSLAPDSLVRKQGKGTNPSGGR

SEQ ID NO: 49789 - protein, 1556 aa, Homo sapiens
MASELGARDDGGCTELAKPLYLQYLERALRLDHFLRQTSAIFNRNISSDDSEDGLDDSNPLLPQSGDPLIQVKEEPPNSLLGETSGAGSSGMLNTYSLNGVLQSESKCDKGNLYNFSKLKKSRKWLKSILLSDESSEADSQSEDDDEEELNLSREELHNMLRLHKYKKLHQNKYSKDKELQQYQYYSAGLLSTYDPFYEQQRHLLGPKKKKFKEEKKLKAKLKKVKKKRRRDEELSSEESPRRHHHQTKVFAKFSHDAPPPGTKKKHLSIEQLNARRRKVWLSIVKKELPKANKQKASARNLFLTNSRKLAHQCMKEVRRAALQAQKNCKETLPRARRLTKEMLLYWKKYEKVEKEHRKRAEKEALEQRKLDEEMREAKRQQRKLNFLITQTELYAHFMSRKRDMGHDGIQEEILRKLEDSSTQRQIDIGGGVVVNITQEDYDSNHFKAQALKNAENAYHIHQARTRSFDEDAKESRAAALRAANKSGTGFGESYSLANPSIRAGEDIPQPTIFNGKLKGYQLKGMNWLANLYEQGINGILADEMGLGKTVQSIALLAHLAERENIWGPFLIISPASTLNNWHQEFTRFVPKFKVLPYWGNPHDRKVIRRFWSQKTLYTQDAPFHVVITSYQLVVQDVKYFQRVKWQYMVLDEAQALKSSSSVRWKILLQFQCRNRLLLTGTPIQNTMAELWALLHFIMPTLFDSHEEFNEWFSKDIESHAENKSAIDENQLSRLHMILKPFMLRRIKKDVENELSDKIEILMYCQLTSRQKLLYQALKNKISIEDLLQSSMGSTQQAQNTTSSLMNLVMQFRKVCNHPELFERQETWSPFHISLKPYHISKFIYRHGQIRVFNHSRDRWLRVLSPFAPDYIQRSLFHRKGINEESCFSFLRFIDISPAEMANLMLQGLLARWLALFLSLKASYRLHQLRSWGAPEGESHQRYLRNKDFLLGVNFPLSFPNLCSCPLLKSLVFSSHCKAVSGYSDQVVHQRRSATSSLRRCLLTELPSFLCVASPRVTAVPLDSYCNDRSAEYERRVLKEGGSLAAKQCLLNGAPELAADWLNRRSQFFPEPAGGLWSIRPQNGWSFIRIPGKESLITDSGKLYALDVLLTRLKSQGHRVLIYSQMTRMIDLLEEYMVYRKHTYMRLDGSSKISERRDMVADFQNRNDIFVFLLSTRAGGLGINLTAADTVIFYDSDWNPTVDQQAMDRAHRLGQTKQVTVYRLICKGTIEERILQRAKEKSEIQRMVISGGNFKPDTLKPKEVVSLLLDDEELEKKLRLRQEEKRQQEETNRVKERKRKREKYAEKKKKEDELDGKRRKEGVNLVIPFVPSADNSNLSADGDDSFISVDSAMPSPFSEISISSELHTGSIPLDESSSDMLVIVDDPASSAPQSRATNSPASITGSVSDTVNGISIQEMPAAGRGHSARSRGRPKGSGSTAKGAGKGRSRKSTAGSAAAMAGAKAGAAAASAAAYAAYGYNVSKGISASSPLQTSLVRPAGLADFGPSSASSPLSSPLSKGNNVPGNPKNLHMTSSLAPDSLVRKQGKGTNPSGGR

SEQ ID NO: 49790 - protein, 1556 aa, Homo sapiens; identical to SEQ ID NO: 49789

SEQ ID NO: 49791 - protein, 194 aa, Homo sapiens
MAASLVGKKIVFVTGNAKKLEEVVQILGDKFPCTLVAQKIDLPEYQGEPDEISIQKCQEAVRQVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 49792 - protein, 153 aa, Homo sapiens
MAASLVGKKIVFVTGNAKKLEEVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 49793 - protein, 177 aa, Homo sapiens
MAASLVVQILGDKFPCTLVAQKIDLPEYQGEPDEISIQKCQEAVRQVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 49794 - protein, 2743 aa, Homo sapiens
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKLISIDELDNAELPPAPDSENATEELEPSPPLRQLEDHKRGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 49795 - protein, 2743 aa, Homo sapiens
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKLISIDELDNAELPPAPDSENATEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 49796 - protein, 2758 aa, Homo sapiens
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKLISIDELDNAELPPAPDSENATEELEPSPPLRQLEDHKRGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 49797 - protein, 2710 aa, Homo sapiens
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 49798 - protein, 2710 aa, Homo sapiens
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGRKENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 49799 - protein, 1204 aa, Homo sapiens
QEPGHCHSRGPGQPSQQPLSQVPQHCAEAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKLISIDELDNAELPPAPDSENATEELEPSPPLRQLEDHKRGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 49800 - protein, 2743 aa, Homo sapiens; identical to SEQ ID NO: 49794

SEQ ID NO: 49801 - protein, 2695 aa, Homo sapiens
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 49802 - protein, 721 aa, Homo sapiens
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 49803 - protein, 181 aa, Homo sapiens
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNDASFWI

SEQ ID NO: 49804 - protein, 2701 aa, Homo sapiens
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNIVVGDKVVLMPVNAGQPLHASNIELLDNPGCKEVNAVNCNTSWKITLFMKYSSYREDVLKGGDVVRLFHAEQEKFLTCDEYEKKQHIFLRTTLRQSATSATSSKALWEIEVVHHDPCRGGAGQWNSLFRFKHLATGNYLAAELNPDYRDAQNEGKNVRDGVPPTSKKKRQAGEKIMYTLVSVPHGNDIASLFELDATTLQRADCLVPRNSYVRLRHLCTNTWVTSTSIPIDTDEERPVMLKIGTCQTKEDKEAFAIVSVPLSEVRDLDFANDANKVLATTVKKLENGTITQNERRFVTKLLEDLIFFVADVPNNGQEVLDVVITKPNRERQKLMREQNILAQVFGILKAPFKEKAGEGSMLRLEDLGDQRYAPYKYMLRLCYRVLRHSQQDYRKNQEYIAKNFCVMQSQIGYDILAEDTITALLHNNRKLLEKHITAKEIETFVSLLRRNREPRFLDYLSDLCVSNTTAIPVTQELICKFMLSPGNADILIQTKVVSMQADNPMESSILSDDIDDEEVWLYWIDSNKEPHGKAIRHLAQEAKEGTKADLEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGGNNVMRTIHGVGEMMTQMVLSRGSIFPMSVPDVPPSIHPSKQGSPTEHEDVTVMDTKLKIIEILQFILSVRLDYRISYMLSIYKKEFGEDNDNAETSASGSPDTLLPSAIVPDIDEIAAQAETMFAGRKEKNPVQLDDEGGRTFLRVLIHLIMHDYPPLLSGALQLLFKHFSQRAEVLQAFKQVQLLVSNQDVDNYKQIKADLDQLRLTVEKSELWVEKSSNYENGEIGESQVKGGEEPIEESNILSPVQDGTKKPQIDSNKSNNYRIVKEILIRLSKLCVQNKKCRNQHQRLLKNMGAHSVVLDLLQIPYEKNDEKMNEVMNLAHTFLQNFCRGNPQNQVLLHKHLNLFLTPGLLEAETMRHIFMNNYHLCNEISERVVQHFVHCIETHGRHVEYLRFLQTIVKADGKYVKKCQDMVMTELINGGEDVLIFYNDRASFPILLHMMCSERDRGDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADIFLEKCVTESIMNIVSGFFNSPFSDNSTSLQTHQPVFIQLLQSAFRIYNCTWPNPAQKASVESCIRTLAEVAKNRGIAIPVDLDSQVNTLFMKSHSNMVQRAAMGWRLSARSGPRFKEALGGPAWDYRNIIEKLQDVVASLEHQFSPMMQAEFSVLVDVLYSPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQYSFYQQLHEQKKSEKFFKVLYDRMKAAQKEIRSTVTVNTIDLGNKKRDDDNELMTSGPRMRVRDSTLHLKEGMKGQLTEASSATSKAYCVYRREMDPEIDIMCTGPEAGNTEEKSAEEVTMSPAIAIMQPILRFLQLLCENHNRELQNFLRNQNNKTNYNLVCETLQFLDCICGSTTGGLGLLGLYINEKNVALVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHISLWGSISFNLAVFINLAVALFYPFGDDGDEGTLSPLFSVLLWIAVAICTSMLFFFSKPVGIRPFLVSIMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGSHQVPTMTLTTMMEACAKENCSPTIPASNTADEEYEDGIERTCDTLLMCIVTVLNQGLRNGGGVGDVLRRPSKDEPLFAARVVYDLLFYFIVIIIVLNLIFGVIIDTFADLRSEKQKKEEILKTTCFICGLERDKFDNKTVSFEEHIKSEHNMWHYLYFIVLVKVKDPTEYTGPESYVAQMIVEKNLDWFPRMRAMSLVSNEGDSEQNEIRSLQEKLESTMSLVKQLSGQLAELKEQMTEQRKNKQRLGFLGSNTPHVNHHMPPH

SEQ ID NO: 49805 - protein, 2671 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 49806 - protein, 441 aa, Homo sapiens
MCVCQTMEVGQYGKNASRAGDRGVLLEPFIHQVGGHSSMMRYDDHTVCKPLISREQRFYESLPPEMKEFTPEYKGVVSVCFEGDSDGYINLVAYPYVESETVEQDDTTEREQPRRKHSRRSLHRSGSGSDHKEEKASLSLETSESSQEAKSPKVELHSHSEVPFQMLDGNSGLSSEKISHNPWSLRCHKQQLSRMRSESKDRKLYKFLLLENVVHHFKYPCVLDLKMGTRQHGDDASAEKAARQMRKCEQSTSATLGVRVCGMQVYQLDTGHYLCRNKYYGRGLSIEGFRNALYQYLHNGLDLRRDLFEPILSKLRGLKAVLERQASYRFYSSSLLVIYDGKECRAESCLDRRSEMRLKHLDMVLPEVASSCGPSTSPSNTSPEAGPSSQPKVDVRMIDFAHSTFKGFRDDPTVHDGPDRGYVFGLENLISIMEQMRDENQ

SEQ ID NO: 49807 - protein, 276 aa, Homo sapiens
MLDGNSGLSSEKISHNPWSLRCHKQQLSRMRSESKDRKLYKFLLLENVVHHFKYPCVLDLKMGTRQHGDDASAEKAARQMRKCEQSTSATLGVRVCGMQVYQLDTGHYLCRNKYYGRGLSIEGFRNALYQYLHNGLDLRRDLFEPILSKLRGLKAVLERQASYRFYSSSLLVIYDGKECRAESCLDRRSEMRLKHLDMVLPEVASSCGPSTSPSNTSPEAGPSSQPKVDVRMIDFAHSTFKGFRDDPTVHDGPDRGYVFGLENLISIMEQMRDENQ

SEQ ID NO: 49808 - protein, 276 aa, Homo sapiens; identical to SEQ ID NO: 49807

SEQ ID NO: 49809 - protein, 426 aa, Homo sapiens
MSPAFRAMDVEPRAKGVLLEPFVHQVGGHSCVLRFNETTLCKPLVPREHQFYETLPAEMRKFTPQYKGVVSVRFEEDEDRNLCLIAYPLKGDHGIVDIVDNSDCEPKSKLLRWTTNKKHHVLETEKTPKDWVRQHRKEEKMKSHKLEEEFEWLKKSEVLYYTVEKKGNISSQLKHYNPWSMKCHQQQLQRMKENAKHRNQYKFILLENLTSRYEVPCVLDLKMGTRQHGDDASEEKAANQIRKCQQSTSAVIGVRVCGMQVYQAGSGQLMFMNKYHGRKLSVQGFKEALFQFFHNGRYLRRELLGPVLKKLTELKAVLERQESYRFYSSSLLVIYDGKERPEVVLDSDAEDLEDLSEESADESAGAYAYKPIGASSVDVRMIDFAHTTCRLYGEDTVVHEGQDAGYIFGLQSLIDIVTEISEESGE

SEQ ID NO: 49810 - protein, 97 aa, Homo sapiens
MSPAFRAMDVEPRAKGVLLEPFVHQVGGHSCVLRFNETTLCKPLVPREHQFYETLPAEMRKFTPQYKGQSQRPLVSWPSLPHFFPWSFPLWPQGSVA

SEQ ID NO: 49811 - protein, 97 aa, Homo sapiens; identical to SEQ ID NO: 49810

SEQ ID NO: 49812 - protein, 185 aa, Homo sapiens
MSLNLPEASLLSRASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGKSQLLEGLPHWRGDVRDRGHGRPWQPSLEPSLPPTLCFPSLSSFSSSWPSAQHLTPSVFNPW

SEQ ID NO: 49813 - protein, 87 aa, Homo sapiens
MSPAFRAMDVEPRAKGVLLEPFVHQVGGHSCVLRFNETTLCKPLVPREHQFYETLPAEMRKFTPQYKGDISSHQHGGVFVGEWGSLL

SEQ ID NO: 49814 - protein, 188 aa, Homo sapiens
MNLCQSPFQEGCQSLLASWPEQAKEPRREGHTDKQQTEDVLAAGLRCLPHLPAICARRMSPAFRAMDVEPRAKGVLLEPFVHQVGGHSCVLRFNETTLCKPLVPREHQFYETLPAEMRKFTPQYKGKSQLLEGLPHWRGDVRDRGHGRPWQPSLEPSLPPTLCFPSLSSFSSSWPSAQHLTPSVFNPW

SEQ ID NO: 49815 - protein, 410 aa, Homo sapiens
MVVQNSADAGDMRAGVQLEPFLHQVGGHMSVMKYDEHTVCKPLVSREQRFYESLPLAMKRFTPQYKGTVTVHLWKDSTGHLSLVANPVKESQEPFKVSTESAAVAIWQTLQQTTGSNGSDCTLAQWPHAQLARSPKESPAKALLRSEPHLNTPAFSLVEDTNGNQVERKSFNPWGLQCHQAHLTRLCSEYPENKRHRFLLLENVVSQYTHPCVLDLKMGTRQHGDDASEEKKARHMRKCAQSTSACLGVRICGMQVYQTDKKYFLCKDKYYGRKLSVEGFRQALYQFLHNGSHLRRELLEPILHQLRALLSVIRSQSSYRFYSSSLLVIYDGQEPPERAPGSPHPHEAPQAAHGSSPGGLTKVDIRMIDFAHTTYKGYWNEHTTYDGPDPGYIFGLENLIRILQDIQEGE

SEQ ID NO: 49816 - protein, 410 aa, Homo sapiens; identical to SEQ ID NO: 49815

SEQ ID NO: 49817 - protein, 359 aa, Homo sapiens
MAPMGIRLSPLGVAVFCLLGLGVLYHLYSGFLAGRFSLFGLGGEPGGGAAGPAAAADGGTVDLREMLAVSVLAAVRGGDEVRRVRESNVLHEKSKGKTREGAEDKMTSGDVLSNRKMFYLLKTAFPSVQINTEEHVDAADQEVILWDHKIPEDILKEVTTPKEVPAESVTVWIDPLDATQEYTEDLRKYVTTMVCVAVNGKPMLGVIHKPFSEYTAWAMVDGGSNVKARSSYNEKTPRIVVSRSHSGMVKQVALQTFGNQTTIIPAGGAGYKVLALLDVPDKSQEKADLYIHVTYIKKWDICAGNAILKALGGHMTTLSGEEISYTGSDGIEGGLLASIRMNHQALVRKLPDLEKTGHK

SEQ ID NO: 49818 - protein, 416 aa, Homo sapiens
MATEPPSPLRVEAPGPPEMRTSPAIESTPEGTPQPAGGRLRFLNGCVPLSHQVAGHMYGKDKVGILQHPDGTVLKQLQPPPRGPRELEFYNMVYAADCFDGVLLELRKYLPKYYGIWSPPTAPNDLYLKLEDVTHKFNKPCIMDVKIGQKSYDPFASSEKIQQQVSKYPLMEEIGFLVLGMRVYHVHSDSYETENQHYGRSLTKETIKDGVSRFFHNGYCLRKDAVAASIQKIEKILQWFENQKQLNFYASSLLFVYEGSSQPTTTKLNDRTLAEKFLSKGQLSDTEVLEYNNNFHVLSSTANGKIESSVGKSLSKMYARHRKIYTKKHHSQTSLKVENLEQDNGWKSMSQEHLNGNVLSQLEKVFYHLPTGCQEIAEVEVRMIDFAHVFPSNTIDEGYVYGLKHLISVLRSILDN

SEQ ID NO: 49819 - protein, 1258 aa, Homo sapiens
MASACGAPGPGGALGSQAPSWYHRDLSRAAAEELLARAGRDGSFLVRDSESVAGAFALCVLYQKHVHTYRILPDGEDFLAVQTSQGVPVRRFQTLGELIGLYAQPNQGLVCALLLPVEGEREPDPPDDRDASDGEDEKPPLPPRSGSTSISAPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPPPKNSFNNPAYYVLEGVPHQLLPPEPPSPARAPVPSATKNKVAITVPAPQLGHHRHPRVGEGSSSDEESGGTLPPPDFPPPPLPDSAIFLPPSLDPLPGPVVRGRGGAEARGPPPPKAHPRPPLPPGPSPASTFLGEVASGDDRSCSVLQMAKTLSEVDYAPAGPARSALLPGPLELQPPRGLPSDYGRPLSFPPPRIRESIQEDLAEEAPCLQGGRASGLGEAGMSAWLRAIGLERYEEGLVHNGWDDLEFLSDITEEDLEEAGVQDPAHKRLLLDTLQLSK

SEQ ID NO: 49820 - protein, 34 aa, Homo sapiens
MVTRLLQQQNLPQTGEQELESLVLKLSVLKDFLS

SEQ ID NO: 49821 - protein, 1016 aa, Homo sapiens
MVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPPPKNSFNNPAYYVLEGVPHQLLPPEPPSPARAPVPSATKNKVAITVPAPQLGHHRHPRVGEGSSSDEESGGTLPPPDFPPPPLPDSAIFLPPSLDPLPGPVVRGRGGAEARGPPPPKAHPRPPLPPGPSPASTFLGEVASGDDRSCSVLQMAKTLSEVDYAPAGPARSALLPGPLELQPPRGLPSDYGRPLSFPPPRIRESIQEDLAEEAPCLQGGRASGLGEAGMSAWLRAIGLERYEEGLVHNGWDDLEFLSDITEEDLEEAGVQDPAHKRLLLDTLQLSK

SEQ ID NO: 49822 - protein, 22 aa, Homo sapiens
MASACGAPGPGGALGSQAPSWY

SEQ ID NO: 49823 - protein, 1016 aa, Homo sapiens; identical to SEQ ID NO: 49821

SEQ ID NO: 49824 - protein, 18 aa, Homo sapiens
MASACGAPGPGGALGSQA

SEQ ID NO: 49825 - protein, 157 aa, Homo sapiens
MVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSAR

SEQ ID NO: 49826 - protein, 399 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNTLRWKGQCYWGLSYMGTNMHSLQLTISRRNGSETHTGNTGSEAAFSPSFSAVISTSEKETIKAALSRVCGDRIFGAAGAGYKSLCVVQGLVDIYIFSEDTTFKWDSCAAHAILRAMGGGIVDLKECLERNPETGLDLPQLVYHVENEGAAGVDRWANKGGLIAYRSRKRLETFLSLLVQNLAPAETHT

SEQ ID NO: 49827 - protein, 399 aa, Homo sapiens; identical to SEQ ID NO: 49826

SEQ ID NO: 49828 - protein, 155 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPI

SEQ ID NO: 49829 - protein, 88 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDW

SEQ ID NO: 49830 - protein, 212 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNT

SEQ ID NO: 49831 - protein, 9 aa, Homo sapiens
MSDILRELL

SEQ ID NO: 49832 - protein, 213 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNTL

SEQ ID NO: 49833 - protein, 190 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYD

SEQ ID NO: 49834 - protein, 30 aa, Homo sapiens
MSDILRELLCVSEKAANIARACRQQEALFQ

SEQ ID NO: 49835 - protein, 68 aa, Homo sapiens
MSDILRELLCVSEKAANIARACRQQEALFQLLIEEKKEGEKNKKFAVDFKTLADVLVQEVIKQNMENK

SEQ ID NO: 49836 - protein, 143 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINV

SEQ ID NO: 49837 - protein, 399 aa, Homo sapiens; identical to SEQ ID NO: 49826

SEQ ID NO: 49838 - protein, 977 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKGNPDSHAYWIRPEDPFCDVPSSPCPSTMPSTACHPHLTTHCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 49839 - protein, 938 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 49840 - protein, 954 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSIGTREVVTQKNLSGLVPIRDLRLDPSLLCSIPLLALSPNLLIVWLFLSIAYLVTKLRCK

SEQ ID NO: 49841 - protein, 972 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKGNPDSHAYWIRPEDPFCDVPSSPCPSTMPSTACHPHLTTHCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 49842 - protein, 977 aa, Homo sapiens; identical to SEQ ID NO: 49838

SEQ ID NO: 49843 - protein, 938 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKQQEESRTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 49844 - protein, 1006 aa, Homo sapiens
MEGQSSRGSRRPGTRAGLGSLPMPQGVAQTGAPSKVDSSFQLPAKKNAALGPSEPRLALAPVGPRAAMSASSEGPRLALASPRPILAPLCTPEGQKTATAHRSSSLAPTSVGQLVMSASAGPKPPPATTGSVLAPTSLGLVMPASAGPRSPPVTLGPNLAPTSRDQKQEPPASVGPKPTLAASGLSLALASEEQPPELPSTPSPVPSPVLSPTQEQALAPASTASGAASVGQTSARKRDAPAPRPLPASEGHLQPPAQTSGPTGSPPCIQTSPDPRLSPSFRARPEALHSSPEDPVLPRPPQTLPLDVGQGPSEPGTHSPGLLSPTFRPGAPSGQTVPPPLPKPPRSPSRSPSHSPNRSPCVPPAPDMALPRLGTQSTGPGRCLSPNLQAQEAPAPVTTSSSTSTLSSSPWSAQPTWKSDPGFRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 49845 - protein, 639 aa, Homo sapiens
MALPRLGTQSTGPGRCLSPNLQAQEAPAPVTTSSSTSTLSSSPWSAQPTWKSDPGFRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 49846 - protein, 638 aa, Homo sapiens
MEGQSSRGSRRPGTRAGLGSLPMPQGVAQTGAPSKVDSSFQLPAKKNAALGPSEPRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 49847 - protein, 639 aa, Homo sapiens; identical to SEQ ID NO: 49845

SEQ ID NO: 49848 - protein, 939 aa, Homo sapiens
MSASSEGPRLALASPRPILAPLCTPEGQKTATAHRSSSLAPTSVGQLVMSASAGPKPPPATTGSVLAPTSLGLVMPASAGPRSPPVTLGPNLAPTSRDQKQEPPASVGPKPTLAASGLSLALASEEQPPELPSTPSPVPSPVLSPTQEQALAPASTASGAASVGQTSARKRDAPAPRPLPASEGHLQPPAQTSGPTGSPPCIQTSPDPRLSPSFRARPEALHSSPEDPVLPRPPQTLPLDVGQGPSEPGTHSPGLLSPTFRPGAPSGQTVPPPLPKPPRSPSRSPSHSPNRSPCVPPAPDMALPRLGTQSTGPGRCLSPNLQAQEAPAPVTTSSSTSTLSSSPWSAQPTWKSDPGFRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 49849 - protein, 1177 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGQMLRTVPGIGKVKEEDHVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 49850 - protein, 810 aa, Homo sapiens
KREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 49851 - protein, 221 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYG

SEQ ID NO: 49852 - protein, 810 aa, Homo sapiens; identical to SEQ ID NO: 49850

SEQ ID NO: 49853 - protein, 810 aa, Homo sapiens; identical to SEQ ID NO: 49850

SEQ ID NO: 49854 - protein, 941 aa, Homo sapiens
RPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 49855 - protein, 222 aa, Homo sapiens [sequence omitted]

SEQ ID NO: 49856 - protein, 941 aa, Homo sapiens
PPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 49857 - protein, 596 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGYCLEVLLSYPLSLLSQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQ

SEQ ID NO: 49858 - protein, 278 aa, Homo sapiens
  MOD_RES (1)..(1): Any amino acid
XQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVELLEFDKELSVFKDRLYELDISFPPSYPYSEDARQGEQYMNTRCPAWCDRILMSPSAKELVLR

SEQ ID NO: 49859 - protein, 387 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRVSVCCPSPGHRGMWSAGSGLAQPW

SEQ ID NO: 49860 - protein, 412 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 49861 - protein, 185 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPERHVPHTSLEALLILHEDPQLPDPHLPL

SEQ ID NO: 49862 - protein, 355 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVELLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 49863 - protein, 138 aa, Homo sapiens
VTANVGSLFDDPENLQKNWLREFYQALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLD

SEQ ID NO: 49864 - protein, 329 aa, Homo sapiens
MKEYNRARVYLDENYKSQEHFTALGSFYFLHESLKNIYQFDFKAKKYRKVAGKEIYSDTLESTPMLEKEKFPLLPRVQMVKKRLHPDEVIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 49865 - protein, 104 aa, Homo sapiens
LDISFPPSYPYSEDARQGEQYMNTRCPAWCDRILMSPSAKELVLRSESEEKVVTYDHIGPNVCMGDHKPVFLAFRIMPGAGKRCQRHERTLREPPCSRGPNTHS

SEQ ID NO: 49866 - protein, 181 aa, Homo sapiens
AAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPERHVPHTSLEALLILHEDPQLPDPHLPL

SEQ ID NO: 49867 - protein, 152 aa, Homo sapiens
MAGKAAAPGTAVLLVTANVGSLFDDPENLQKNWLREFYQALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLD

SEQ ID NO: 49868 - protein, 644 aa, Homo sapiens
MPSKAENLRPSEPAPQPPEGRTLQGQLPGAPPAQRAGSPPDAPGSESPALACSTPATPSGEDPPARAAPIAPRPPARPRLERALSLDDKGWRRRRFRGSQEDLEARNGTSPSRGSVQSEGPGAPAHSCSPPCLSTSLQEIPKSRGVLSSERGSPSSGGNPLSGVASSSPNLPHRDAAVAGSSPRLPSLLPPRPPPALSLDIASDSLRTANKVDSDLADYKLRAQPLLVRAHSSLGPGRPRSPLACDDCSLRSAKSSFSLLAPIRSKDVRSRSYLEGSLLASGALLGADELARYFPDRNVALFVATWNMQGQKELPPSLDEFLLPAEADYAQDLYVIGVQEGCSDRREWETRLQETLGPHYVLLSSAAHGVLYMSLFIRRDLIWFCSEVECSTVTTRIVSQIKTKGALGISFTFFGTSFLFITSHFTSGDGKVAERLLDYTRTVQALVLPRNVPDTNPYRSSAADVTTRFDEVFWFGDFNFRLSGGRTVVDALLCQGLVVDVPALLQHDQLIREMRKGSIFKGFQEPDIHFLPSYKFDIGKDTYDSTSKQRTPSYTDRVLYRSRHKGDICPVSYSSCPGIKTSDHRPVYGLFRVKVRPGRDNIPLAAGKFDRELYLLGIKRRISKEIQRQQALQSQNSSTICSVS

SEQ ID NO: 49869 - protein, 319 aa, Homo sapiens
MDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGRYPSRKKRWGLEEARPQGAGSVLFWGGAMEKTGFRLMERAHGGGFVWGRSARDGRRDEELEEAGREMSAAAGSRERNTAGSAGGGKLGWGAGPGAAVRPALGWAGSAVWPVDARGEDQSPGGPLEAGTLGQKFCDVLLRRA

SEQ ID NO: 49870 - protein, 993 aa, Homo sapiens
MDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGRYPSRKKRWGLEEARPQGAGSVLFWGGAMEKTGFRLMERAHGGGFVWGRSARDGRRDEELEEAGREMSAAAGSRERNTAGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKMTATKLNSGEDKIEDILVLHLDRGKDYFLSVSGNYLPSCFGSPIHTLCYMREPILDLPLETISELTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 49871 - protein, 913 aa, Homo sapiens
MDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKMTATKLNSGEDKIEDILVLHLDRGKDYFLSVSGNYLPSCFGSPIHTLCYMREPILDLPLETISELTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 49872 - protein, 993 aa, Homo sapiens; identical to SEQ ID NO: 49870

SEQ ID NO: 49873 - protein, 749 aa, Homo sapiens
MSAAAGSRERNTAGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKMTATKLNSGEDKIEDILVLHLDRGKDYFLSVSGNYLPSCFGSPIHTLCYMREPILDLPLETISELTLMPVWTGDDGSQLDSPMEIPKELWMMVDYLYRNAVQQEDLFQQPGLRSEFEHIRDCLDTGMIDNLSASNHSVAEALLLFLESLPEPVICYSTYHNCLECSGNYTASKQVISTLPIFHKNVFHYLMAFLRELLKNSAKNHLDENILASIFGSLLLRNPAGHQKLDMTEKKKAQEFIHQFLCNPL

SEQ ID NO: 49874 - protein, 828 aa, Homo sapiens
MDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGRYPSRKKRWGLEEARPQGAGSVLFWGGAMEKTGFRLMERAHGGGFVWGRSARDGRRDEELEEAGREMSAAAGSRERNTAGGSNFDGLRPNGKGVPMDQSSRGQDKPESLQPRQNKSKSEITDMVRSSTITVSDKAHILSMQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMGNKGGVAIRFQFHNTSICVVNSHLAAHIEEYERRNQDYKDICSRMQFCQPDPSLPPLTISNHDVILWLGDLNYRIEELDVEKVKKLIEEKDFQMLYAYDQLKIQVAAKTVFEGFTEGELTFQPTYKYDTGSDDWDTSEKCRAPAWCDRILWKGKNITQLSYQSHMALKTSDHKPVSSVFDIGVRVVNDELYRKTLEEIVRSLDKMENANIPSVSLSKREFCFQNVKYMQLKVESFTIHNGQVPCHFEFINKPDEESYCKQWLNANPSRGFLLPDSDVEIDLELFVNKMTATKLNSGEDKIEDILVLHLDRGKDYFLSVSGNYLPSCFGSPIHTLCYMREPILDLPLETISELLAYLAAYCFETQLVTKSLI

SEQ ID NO: 49875 - protein, 175 aa, Homo sapiens
MQKFGLRDTIVKSHLLQKEEDYTYIQNFRFFAGTYNVNGQSPKECLRLWLSNGIQAPDVYCVGFQELDLSKEAFFFHDTPKEEEWFKAVSEGLHPDAKYAKVKLIRLVGIMLLLYVKQEHAAYISEVEAETVGTGIMGRMCDLVAGGPQLQDRRAGCGKSEKAHRREGLSNAVCI

SEQ ID NO: 49876 - protein, 277 aa, Homo sapiens
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 49877 - protein, 198 aa, Homo sapiens
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEGSGVLEQQLLICALWQLAEQMHIMKWEFTAGMLQELALLLLKLVAC

SEQ ID NO: 49878 - protein, 336 aa, Homo sapiens
MGQRPGPVLPAVAVLGQVAKRKVAWLLRWKAVTRTETAGNSSGVYGFGKMKIFVKYFQKMADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 49879 - protein, 153 aa, Homo sapiens
MADPWQECMDYAVTLARQAGEVVCEAIKNEMNVMLKSSPVDLVTATDQKVEKMLISSIKEKYPSHRFPFVAVSIGFAVNKKIEFGVVYSCVEGKMYTARKGKGAFCNGQKLQVSQQEDITKSLLVTELGSSRTPETVRMVLSNMEKLFCIPVH

SEQ ID NO: 49880 - protein, 211 aa, Homo sapiens
MGQRPGPVLPAVAVLGQVAKRKVAWLLRWKAVTRTETAGNSSGVYGFGKMKIFVKYFQKMADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQE

SEQ ID NO: 49881 - protein, 288 aa, Homo sapiens
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETDLSKALVLTEIGPKRDPATLKLFLSNMERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 49882 - protein, 85 aa, Homo sapiens
MKPSGEDQAALAAGPWEECFQAAVQLALRAGQIIRKALTEEKRVSTKTSAADLVTETDHLVEDLIISELRERFPSHRSPFSLVHM

SEQ ID NO: 49883 - protein, 356 aa, Homo sapiens
MLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 49884 - protein, 558 aa, Homo sapiens
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 49885 - protein, 504 aa, Homo sapiens
MEAAAQFFVESPDVVYGPEAIEAQYEYRTTRVSREGGVLKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 49886 - protein, 408 aa, Homo sapiens
MRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 49887 - protein, 461 aa, Homo sapiens
MTLPGGPTGMARPGGARPCSPGLERAPRRSVGELRLLFEARCAAVAAAAAAGEPRARGAKRRGGQVPNGLPRAPPAPVIPQLTVTAEEPDVPPTSPGPPERERDCLPAAGSSHLQQPRRLSTSSVSSTGSSSLLEDSEDDLLSDSESRSRGNVQLEAGEDVGQKNHWQKIRTMVNLPVISPFKKRYAWVQLAGHTGSFKAAGTSGLILKRCSEPERYCLARLMADALRGCVPAFHGVVERDGESYLQLQDLLDGFDGPCVLDCKMGVRTYLEEELTKARERPKLRKDMYKKMLAVDPEAPTEEEHAQRAVTKPRYMQWREGISSSTTLGFRIEGIKKADGSCSTDFKTTRSREQVLRVFEEFVQGDEEVLRRYLNRLQQIRDTLEVSEFFRRHEVIGSSLLFVHDHCHRAGVWLIDFGKTTPLPDGQILDHRRPWEEGNREDGYLLGLDNLIGILASLAER

SEQ ID NO: 49888 - protein, 946 aa, Homo sapiens
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFVRMEKGIPASPRCGSPTAMEIDKRGSPTPGTRSCLAPSLGLFGASLTMATEVAARVTSTGPHRPQDLALTEPSGRARELEDLQPPEALVERQGQFLGSETSPAPERGGPRDGEPPGKMGKGYLPCGMPGSGEPEVGKRPEETTVSVQSAESSDSLSWSRLPRALASVGPEEARSGAPVGGGRWQLSDRVEGGSPTLGLLGGSPSAQPGTGNVEAGIPSGRMLEPLPCWDAAKDLKEPQCPPGDRVGVQPGNSRVWQGTMEKAGLAWTRGTGVQSEGTWESQRQDSDALPSPELLPQDPDKPFLRKACSPSNIPAVIITDMGTQEDGALEETQGSPRGNLPLRKLSSSSASSTGFSSSYEDSEEDISSDPERTLDPNSAFLHTLDQQKPRVSKSWRKIKNMVHWSPFVMSFKKKYPWIQLAGHAGSFKAAANGRILKKHCESEQRCLDRLMVDVLRPFVPAYHGDVVKDGERYNQMDDLLADFDSPCVMDCKMGIRTYLEEELTKARKKPSLRKDMYQKMIEVDPEAPTEEEKAQRAVTKPRYMQWRETISSTATLGFRIEGIKKEDGTVNRDFKKTKTREQVTEAFREFTKGNHNILIAYRDRLKAIRTTLEVSPFFKCHEVIGSSLLFIHDKKEQAKVWMIDFGKTTPLPEGQTLQHDVPWQEGNREDGYLSGLNNLVDILTEMSQDAPLA

SEQ ID NO: 49889 - protein, 644 aa, Homo sapiens
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFVRMEKGIPASPRCGSPTAMEIDKRGSPTPGTRSCLAPSLGLFGASLTMATEVAARVTSTGPHRPQDLALTEPSGRARELEDLQPPEALVERQGQFLGSETSPAPERGGPRDGEPPGKMGKGYLPCGMPGSGEPEVGKRPEETTVSVQSAESSDSLSWSRLPRALASVGPEEARSGAPVGGGRWQLSDRVEGGSPTLGLLGGSPSAQPGTGNVEAGIPSGRMLEPLPCWDAAKDLKEPQCPPGDRVGVQPGNSRVWQGTMEKAGLAWTRGTGVQSEGTWESQRQDSDALPSPELLPQDPDKPFLRKACSPSNIPAVIITDMGTQEDGALEETQGSPRGNLPLRKLSSSSASSTGFSSSYEDSEEDISSDPERTLDPNSAFLHTLDQQKPRV

SEQ ID NO: 49890 - protein, 946 aa, Homo sapiens; identical to SEQ ID NO: 49888

SEQ ID NO: 49891 - protein, 683 aa, Homo sapiens
MRRCPCRGSLNEAEAGALPAAARMGLEAPRGGRRRQPGQQRPGPGAGAPAGRPEGGGPWARTEGSSLHSEPERAGLGPAPGTESPQAEFWTDGQTEPAAAGLGVETERPKQKTEPDRSSLRTHLEWSWSELETTCLWTETGTDGLWTDPHRSDLQFQPEEASPWTQPGVHGPWTELETHGSQTQPERVKSWADNLWTHQNSSSLQTHPEGACPSKEPSADGSWKELYTDGSRTQQDIEGPWTEPYTDGSQKKQDTEAARKQPGTGGFQIQQDTDGSWTQPSTDGSQTAPGTDCLLGEPEDGPLEEPEPGELLTHLYSHLKCSPLCPVPRLIITPETPEPEAQPVGPPSRVEGGSGGFSSASSFDESEDDVVAGGGGASDPEDRSGSKPWKKLKTVLKYSPFVVSFRKHYPWVQLSGHAGNFQAGEDGRILKRFCQCEQRSLEQLMKDPLRPFVPAYYGMVLQDGQTFNQMEDLLADFEGPSIMDCKMGSRTYLEEELVKARERPRPRKDMYEKMVAVDPGAPTPEEHAQGAVTKPRYMQWRETMSSTSTLGFRIEGIKKADGTCNTNFKKTQALEQVTKVLEDFVDGDHVILQKYVACLEELREALEISPFFKTHEVVGSSLLFVHDHTGLAKVWMIDFGKTVALPDHQTLSHRLPWAEGNREDGYLWGLDNMICLLQGLAQS

SEQ ID NO: 49892 - protein, 579 aa, Homo sapiens
MRRPPGNGEAASEGPGGWGLWGVQESRRLCCAGHDRCKQALLQIGINMMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKEGGVVALFKVCRQDSFRCLYPQALRTLASICCVEEGVHQLEKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 49893 - protein, 532 aa, Homo sapiens
MMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKEGGVVALFKVCRQDSFRCLYPQALRTLASICCVEEGVHQLEKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 49894 - protein, 308 aa, Homo sapiens
MMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQVESHSVTRLECSGAISAQCNLRLLGSSDSPASASQALVRKIDASDNIYTTESTTGNLFSLTQEGAPLCRIIAKEGGVVALFKVCRQDSFRCLYPQALRTLASICCVEEGVHQLEK

SEQ ID NO: 49895 - protein, 490 aa, Homo sapiens
MMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 49896 - protein, 490 aa, Homo sapiens; identical to SEQ ID NO: 49895

SEQ ID NO: 49897 - protein, 532 aa, Homo sapiens; identical to SEQ ID NO: 49893

SEQ ID NO: 49898 - protein, 277 aa, Homo sapiens
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAAVVGLLYPCIDSHLGEPHKFKREWASVMRCIAVFVGINHASAKLDFANNVQLSLTLAALSLGLWWTFDRSRSGLGLGITIAFLATLITQFLVYNGVYQYTSPDFLYIRSWLPCIFFSGGVTVGNIGRQLAMGVPEKPHSD

SEQ ID NO: 49899 - protein, 178 aa, Homo sapiens
MPRLHDHFWSCSCAHSARRRGPPRASAKLDFANNVQLSLTLAALSLGLWWTFDRSRSGLGLGITIAFLATLITQFLVYNGVYQYTSPDFLYIRSWLPCIFFSGGVTVGNIGRQLAMLIPFCEELNLKTTWLFHKTRSNYRVFLKSPIVIESSKPPILRARKILEENLTVDYDKDYLFS

SEQ ID NO: 49900 - protein, 123 aa, Homo sapiens
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIF

SEQ ID NO: 49901 - protein, 164 aa, Homo sapiens
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAGIHPQISSIFVLGSLVYFSQEASRWGT

SEQ ID NO: 49902 - protein, 225 aa, Homo sapiens
MAEGETESPGPKKCGPYISSVTSQSVNLMIRGVVLFFIGVFLALVLNLLQIQRNVTLFPPDVIASIFSSAWWVPPCCGTASAVIGLLYPCIDRHLGEPHKFKREWSSVMRCVAVFVGINHASAKVDFDNNIQLSLTLAALSIGLWWTFDRSRSGFGLGVGIAFLATVVTQLLVYNGVYQYTSPDFLYVRSWLPCIFFAGGITMGNIGRQLAMYECKVIAEKSHQE

SEQ ID NO: 49903 - protein, 1382 aa, Homo sapiens
MATGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 49904 - protein, 1370 aa, Homo sapiens
MATGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 49905 - protein, 83 aa, Homo sapiens
PYQNVTEFDGQDACGSNSWTVVDIDPPLRSNDPKSQNHPGWLMRGLKPWTQYAIFVKTLVTFSDERRTYGAKSDIIYVQTDAT

SEQ ID NO: 49906 - protein, 1338 aa, Homo sapiens
MASPPRHGPPGPASGDGPNLNNNNNNNNHSVRKCGYLRKQKHGHKRFFVLRGPGAGGDEATAGGGSAPQPPRLEYYESEKKWRSKAGAPKRVIALDCCLNINKRADAKHKYLIALYTKDEYFAVAAENEQEQEGWYRALTDLVSEGRAAAGDAPPAAAPAASCSASLPGALGGSAGAAGAEDSYGLVAPATAAYREVWQVNLKPKGLGQSKNLTGVYRLCLSARTIGFVKLNCEQPSVTLQLMNIRRCGHSDSFFFIEVGRSAVTGPGELWMQADDSVVAQNIHETILEAMKALKELFEFRPRSKSQSSGSSATHPISVPGARRHHHLVNLPPSQTGLVRRSRTDSLAATPPAAKCSSCRVRTASEGDGGAAAGAAAAGARPVSVAGSPLSPGPVRAPLSRSHTLSGGCGGRGSKVALLPAGGALQHSRSMSMPVAHSPPAATSPGSLSSSSGHGSGSYPPPPGPHPPLPHPLHHGPGQRPSSGSASASGSPSDPGFMSLDEYGSSPGDLRAFCSHRSNTPESIAETPPARDGGGGGEFYGYMTMDRPLSHCGRSYRRVSGDAAQDLDRGLRKRTYSLTTPARQRPVPQPSSASLDEYTLMRATFSGSAGRLCPSCPASSPKVAYHPYPEDYGDIEIGSHRSSSSNLGADDGYMPMTPGAALAGSGSGSCRSDDYMPMSPASVSAPKQILQPRAAAAAAAAVPSAGPAGPAPTSAAGRTFPASGGGYKASSPAESSPEDSGYMRMWCGSKLSMEHADGKLLPNGDYLNVSPSDAVTTGTPPDFFSAALHPGGEPLRGVPGCCYSSLPRSYKAPYTCGGDSDQYVLMSSPVGRILEEERLEPQATPGPSQAASAFGAGPTQPPHPVVPSPVRPSGGRPEGFLGQRGRAVRPTRLSLEGLPSLPSMHEYPLPPEPKSPGEYINIDFGEPGARLSPPAPPLLASAASSSSLLSASSPASSLGSGTPGTSSDSRQRSPLSDYMNLDFSSPKSPKPGAPSGHPVGSLDGLLSPEASSPYPPLPPRPSASPSSSLQPPPPPPAPGELYRLPPASAVATAQGPGAASSLSSDTGDNGDYTEMAFGVAATPPQPIAAPPKPEAARVASPTSGVKRLSLMEQVSGVEAFLQASQPPDPHRGAKVIRADPQGGRRRHSSETFSSTTTVTPVSPSFAHNPKRHNSASVENVSLRKSSEGGVGVGPGGGDEPPTSPRQLQPAPPLAPQGRPWTPGQPGGLVGCPGSGGSPMRRETSAGFQNGLNYIAIDVREEPGLPPQPQPPPPPLPQPGDKSSWGRTRSLGGLISAVGVGSTGGGCGGPGPGALPPANTYASIDFLSHHLKEATIVKE

SEQ ID NO: 49907 - protein, 1297 aa, Homo sapiens
MAVPSLWPWGACLPVIFLSLGFGLDTVEVCPSLDIRSEVAELRQLENCSVVEGHLQILLMFTATGEDFRGLSFPRLTQVTDYLLLFRVYGLESLRDLFPNLAVIRGTRLFLGYALVIFEMPHLRDVALPALGAVLRGAVRVEKNQELCHLSTIDWGLLQPAPGANHIVGNKLGEECADVCPGVLGAAGEPCAKTTFSGHTDYRCWTSSHCQRVCPCPHGMACTARGECCHTECLGGCSQPEDPRACVACRHLYFQGACLWACPPGTYQYESWRCVTAERCASLHSVPGRASTFGIHQGSCLAQCPSGFTRNSSSIFCHKCEGLCPKECKVGTKTIDSIQAAQDLVGCTHVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHIYRLEEVTGTRGRQNKAEINPRTNGDRAACQTRTLRFVSNVTEADRILLRWERYEPLEARDLLSFIVYYKESPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHREADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLHVLLTATPVGLTLLIVLAALGFFYGKKRNRTLYASVNPEYFSASDMYVPDEWEVPREQISIIRELGQGSFGMVYEGLARGLEAGEESTPVALKTVNELASPRECIEFLKEASVMKAFKCHHVVRLLGVVSQGQPTLVIMELMTRGDLKSHLRSLRPEAENNPGLPQPALGEMIQMAGEIADGMAYLAANKFVHRDLAARNCMVSQDFTVKIGDFGMTRDVYETDYYRKGGKGLLPVRWMAPESLKDGIFTTHSDVWSFGVVLWEIVTLAEQPYQGLSNEQVLKFVMDGGVLEELEGCPLQLQELMSRCWQPNPRLRPSFTHILDSIQEELRPSFRLLSFYYSPECRGARGSLPTTDAEPDSSPTPRDCSPQNGGPGH

SEQ ID NO: 49908 - protein, 1019 aa, Homo sapiens [sequence omitted]

SEQ ID NO: 49909 - protein, 464 aa, Homo sapiens
MSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 49910 - protein, 257 aa, Homo sapiens
EFIIRGGRVPSHCLHFSRSFQKKTYSKMNNPAIKRIGNHITKSPEDKREYRGLELANGIKVLLISDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGNKYTLETRPNQEGIDVRQELLKFHSAYYSSNLMAVCVLGRESLDDLTNLV

SEQ ID NO: 49911 - protein, 131 aa, Homo sapiens
MDPRLPAWALVLLGPALVFALGPAPTPEMREKLCGHHFVRALVRVCGGPRWSTEARRPATGGDRELLQWLERRHLLHGLVADSNLTLGPGLQPLPQTSHHHRHHRAAATNPARYCCLSGCTQQDLLTLCPY

SEQ ID NO: 49912 - protein, 157 aa, Homo sapiens
MDPRLPAWALVLLGPALVFALGPAPTPEMREKLCGHHFVRALVRVCGGPRWSTEARRPATGGDQRESHSVSQAGLKLLSSSNPPTLTFQSVGISDVSCYSGWRDDICSMGWWPTVISRWDLACSPCPRPLTITATTVQLPPTLHATAASVAVPNKTC

SEQ ID NO: 49913 - protein, 139 aa, Homo sapiens
MASLFRSYLPAIWLLLSQLLRESLAAELRGCGPRFGKHLLSYCPMPEKTFTTTPGGWLLESGRPKEMVSTSNNKDGQALGTTSEFIPNLSPELKKPLSEGQPSLKKIILSRKKRSGRHRFDPFCCEVICDDGTSVKLCT

SEQ ID NO: 49914 - protein, 135 aa, Homo sapiens
MKGSIFTLFLFSVLFAISEVRSKESVRLCGLEYIRTVIYICASSRWRRHQEGIPQAQQAETGNSFQLPHKREFSEENPAQNLPKVDASGEDRLWGGQMPTEELWKSKKHSVMSRQDLQTLCCTDGCSMTDLSALC

SEQ ID NO: 49915 - protein, 213 aa, Homo sapiens
MPRLLRLSLLWLGLLLVRFSRELSDISSARKLCGRYLVKEIEKLCGHANWSQFRFEEETPFSRLIAQASEKVEAYSPYQFESPQTASPARGRGTNPVSTSWEEAVNSWEMQSLPEYKDKKGYSPLGKTREFSSSHNINVYIHENAKFQKKRRNKIKTLSNLFWGHHPQRKRRGYSEKCCLTGCTKEELSIACLPYIDFKRLKEKRSSLVTKIY

SEQ ID NO: 49916 - protein, 577 aa, Homo sapiens
MNKLYIGNLNESVTPADLEKVFAEHKISYSGQFLVKSGYAFVDCPDEHWAMKAIETFSGKVELQGKRLEIEHSVPKKQRSRKIQIRNIPPQLRWEVLDSLLAQYGTVENCEQVNTESETAVVNVTYSNREQTRQAIMKLNGHQLENHALKVSYIPDEQIAQGPENGRRGGFGSRGQPRQGSPVAAGAPAKQQQVDIPLRLLVPTQYVGAIIGKEGATIRNITKQTQSKIDVHRKENAGAAEKAISVHSTPEGCSSACKMILEIMHKEAKDTKTADEVPLKILAHNNFVGRLIGKEGRNLKKVEQDTETKITISSLQDLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQHQKGQSNQAQARRK

SEQ ID NO: 49917 - protein, 438 aa, Homo sapiens
MNKLYIGNLNESVTPADLEKVFAEHKISYSGQFLVKSGYAFVDCPDEHWAMKAIETFSGKVELQGKRLEIEHSVPKKQRSRKIQIRNIPPQLRWEVLDSLLAQYGTVENCEQVNTESETAVVNVTYSNREQTRQADEVPLKILAHNNFVGRLIGKEGRNLKKVEQDTETKITISSLQDLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQHQKGQSNQAQARRK

SEQ ID NO: 49918 - protein, 556 aa, Homo sapiens
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 49919 - protein, 599 aa, Homo sapiens
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 49920 - protein, 542 aa, Homo sapiens
MFSCPGHYHVDGFLNPGSRKIQIRNIPPHLQWEVLDGLLAQYGTVENVEQVFAFSLVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNQQANLIPGLNLSALGIFSTGLSVLSPPAGPRGAPPAAPYHPFTTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 49921 - protein, 579 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 49922 - protein, 2491 aa, Homo sapiens
MGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEARPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 49923 - protein, 259 aa, Homo sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 49924 - protein, 258 aa, Homo sapiens
MLPLCLVAALLLAAGPGPSLGDEAIHCPPCSEEKLARCRPPVGCEELVREPGCGCCATCALGLGMPCGVYTPRCGSGLRCYPPRGVEKPLHTLMHGQGVCMELAEIEAIQESLQPSDKDEGDHPNNSFSPCSAHDRRCLQKHFAKIRDRSTSGGKMKVNGAPREDARPVPQGSCQSELHRALERLAASQSRTHEDLYIIPIPNCDRNGNFHPKQCHPALDGQRGKCWCVDRKTGVKLPGGLEPKGELDCHQLADSFRE

SEQ ID NO: 49925 - protein, 158 aa, Homo sapiens
MELAEIEAIQESLQPSDKDEGDHPNNSFSPCSAHDRRCLQKHFAKIRDRSTSGGKMKVNGAPREDARPVPQGSCQSELHRALERLAASQSRTHEDLYIIPIPNCDRNGNFHPKQCHPALDGQRGKCWCVDRKTGVKLPGGLEPKGELDCHQLADSFRE

SEQ ID NO: 49926 - protein, 282 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 49927 - protein, 279 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGTQ

SEQ ID NO: 49928 - protein, 605 aa, Homo sapiens
MALRKGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNVAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 49929 - protein, 643 aa, Homo sapiens
MALRKAGDLEPQFTPERRFRLCWYQAHSGRALLGPPPQASPPAGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNVAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 49930 - protein, 510 aa, Homo sapiens
MPRGFLVKRSKKSTPVSYRVRGGEDGDRALLLSPSCGGARAEPPAPSPVPGPLPPPPPAERAHAALAAALACAPGPQPPPQGPRAAHFGNPEAAHPAPLYSPTRPVSREHEKHKYFERSFNLGSPVSAESFPTPAALLGGGGGGGASGAGGGGTCGGDPLLFAPAELKMGTAFSAGAEAARGPGPGPPLPPAAALRPPGKRPPPPTAAEPPAKAVKAPGAKKPKAIRKLHFEDEVTTSPVLGLKIKEGPVEAPRGRAGGAARPLGEFICQLCKEEYADPFALAQHKCSRIVRVEYRCPECAKVFSCPANLASHRRWHKPRPAPAAARAPEPEAAARAEAREAPGGGSDRDTPSPGGVSESGSEDGLYECHHCAKKFRRQAYLRKHLLAHHQALQAKGAPLAPPAEDLLALYPGPDEKAPQEAAGDGEGAGVLGLSASAECHLCPVCGESFASKGAQERHLRLLHAAQVFPCKYCPATFYSSPGLTRHINKCHPSENRQVILLQVPVRPAC

SEQ ID NO: 49931 - protein, 566 aa, Homo sapiens
MPRGFLVKRTKRTGGLYRVRLAERVFPLLGPQGAPPFLEEAPSASLPGAERATPPTREEPGKGLTAEAAREQSGSPCRAAGVSPGTGGREGAEWRAGGREGPGPSPSPSPSPAKPAGAELRRAFLERCLSSPVSAESFPGGAAAVAAFSCSVAPAAAPTPGEQFLLPLRAPFPEPALQPDPAPLSAALQSLKRAAGGERRGKAPTDCASGPAAAGIKKPKAMRKLSFADEVTTSPVLGLKIKEEEPGAPSRGLGGSRTPLGEFICQLCKEQYADPFALAQHRCSRIVRVEYRCPECDKVFSCPANLASHRRWHKPRPAAANAATVSSADGKPPSSSSSSSRDSGAIASFLAEGKENSRIERTADQHPQARDSSGADQHPDSAPRQGLQVLTHPEPPLPQGPYTEGVLGRRVPVPGSTSGGRGSEIFVCPYCHKKFRRQAYLRKHLSTHEAGSARALAPGFGSERGAPLAFACPLCGAHFPTADIREKHRLWHAVREELLLPALAGAPPETSGPSGPSDGSAQQIFSCKHCPSTFFSSPGLTRHINKCHPSESRQVLLLQMPLRPGC

SEQ ID NO: 49932 - protein, 263 aa, Homo sapiens
MVKIAFNTPTAVQKEEARQDVEALLSRTVRTQILTGKELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 49933 - protein, 219 aa, Homo sapiens
MVKIAFNTPTAVQKEEARQDVEALLSRTVRTQILTGKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 49934 - protein, 266 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLNTSIVMPPRNLLELLINIKAGTYLPQSYLIHEHMVITDRIENIDHLGFFIYRLCHDKETYKLQRRETIKGIQKREASNCFAIRHFENKFAVETLICS

SEQ ID NO: 49935 - protein, 230 aa, Homo sapiens
MVKISFQPAVAGIKGDKADKASASAPAPASATEILLTPAREEQPPQHRSKRGGSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRRGTYLPQTYIIQEEMVVTEHVSDKEALGSFIYHLCNGKDTYRLRRRATRRRINKRGAKNCNAIRHFENTFVVETLICGVV

SEQ ID NO: 49936 - protein, 267 aa, Homo sapiens
MVKISFQPAVAGIKGDKADKASASAPAPASATEILLTPAREEQPPQHRSKRGGSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 49937 - protein, 220 aa, Homo sapiens
MVKISFQPAVAGIKGDKADKASASAPAPASATEILLTPARLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 49938 - protein, 180 aa, Homo sapiens
MVKISFQPAVAGIKGDKADKASASAPAPASATEILLTPAREEQPPQHRSKRGGSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFW

SEQ ID NO: 49939 - protein, 612 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 49940 - protein, 272 aa, Homo sapiens
MDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 49941 - protein, 357 aa, Homo sapiens
MMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 49942 - protein, 464 aa, Homo sapiens
MDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSSHRCLCFHLGNNWHFTLAGKESR

SEQ ID NO: 49943 - protein, 347 aa, Homo sapiens
MSLLCRNKGCGQHFDPNTNLPDSCCHHPGVPIFHDALKGWSCCRKRTVDFSEFLNIKGCTMGPHCAEKLPEAPQPEGPATSSSLQEQKPLNVIPKSAETLRRERPKSELPLKLLPLNISQALEMALEQKELDQEPGAGLDSLIRTGSSCQNPGCDAVYQGPESDATPCTYHPGAPRFHEGMKSWSCCGIQTLDFGAFLAQPGCRVGRHDWGKQLPASCRHDWHQTDSLVVVTVYGQIPLPAFNWVKASQTELHVHIVFDGNRVFQAQMKLWGVINVEQSSVFLMPSRVEISLVKADPGSWAQLEHPDALAKKARAGVVLEMDEEESDDSDDDLSWTEEEEEEEAMGE

SEQ ID NO: 49944 - protein, 329 aa, Homo sapiens
MSTDSCCHHPGVPIFHDALKGWSCCRKRTVDFSEFLNIKGCTMGPHCAEKLPEAPQPEGPATSSSLQEQKPLNVIPKSAETLRRERPKSELPLKLLPLNISQALEMALEQKELDQEPGAGLDSLIRTGSSCQNPGCDAVYQGPESDATPCTYHPGAPRFHEGMKSWSCCGIQTLDFGAFLAQPGCRVGRHDWGKQLPASCRHDWHQTDSLVVVTVYGQIPLPAFNWVKASQTELHVHIVFDGNRVFQAQMKLWGVINVEQSSVFLMPSRVEISLVKADPGSWAQLEHPDALAKKARAGVVLEMDEEESDDSDDDLSWTEEEEEEEAMGE

SEQ ID NO: 49945 - protein, 200 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYDVLHRHALYLIIRMVCYDDGLGAGKSLLALKTTDASNEEYSLWVYQCNSLEQAQAICKVLSTAFDSVLTSEKP

SEQ ID NO: 49946 - protein, 200 aa, Homo sapiens; identical to SEQ ID NO: 49945

SEQ ID NO: 49947 - protein, 84 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEG

SEQ ID NO: 49948 - protein, 96 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQ

SEQ ID NO: 49949 - protein, 86 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPL

SEQ ID NO: 49950 - protein, 136 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYDVLHRHALY

SEQ ID NO: 49951 - protein, 114 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGV

SEQ ID NO: 49952 - protein, 65 aa, Homo sapiens
MFRKGKKRHSSSSSQSSEISTKSKSVDSSLGGLSRSSTVASLDTDSTKSSGQSNNNSDTCAEFRI

SEQ ID NO: 49953 - protein, 150 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYEQAQAICKVLSTAFDSVLTSEKP

SEQ ID NO: 49954 - protein, 177 aa, Homo sapiens
MPVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKASRHLDSYEFLKAILN

SEQ ID NO: 49955 - protein, 170 aa, Homo sapiens
MPVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKGQPQMSQPL

SEQ ID NO: 49956 - protein, 216 aa, Homo sapiens
MPFAPVAQARVQWHDFRSLQHLLPAFKRFSCLSLGSSWDYSVKRSLKLDGLLEENSFDPSKITRKKSVITYSPTTGTCQMSLFASPTSSEEQKHRNGLSNEKRKKLNHPSLTESKESTTKDNDEFMMLLSKVEKLSEEIMEIMQNLSSIQALEGSRELENLIGISCASHFLKREMQKTKELMTKVNKQKLFEKSTGLPHKASRHLDSYEFLKAILN

SEQ ID NO: 49957 - protein, 1179 aa, Homo sapiens
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 49958 - protein, 1188 aa, Homo sapiens
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 49959 - protein, 1189 aa, Homo sapiens
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEVANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 49960 - protein, 823 aa, Homo sapiens
MSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 49961 - protein, 650 aa, Homo sapiens
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWTPPPKCWSEAPEETLS

SEQ ID NO: 49962 - protein, 1181 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 49963 - protein, 815 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQLMGQK

SEQ ID NO: 49964 - protein, 641 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQLLCTIISCQTCSFRKSWDPMEPLGAISSTLGGPWMAMEI

SEQ ID NO: 49965 - protein, 942 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTR

SEQ ID NO: 49966 - protein, 1039 aa, Homo sapiens
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRGEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 49967 - protein, 1005 aa, Homo sapiens
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRGEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQVWTQLLRALEERAIPIWWVLVGVLGGLLLLTILVLAMWKVGFFKRNRPPLEEDDEEGE

SEQ ID NO: 49968 - protein, 219 aa, Homo sapiens
MASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPGALDCLQLEMPKKGPWTFAGSAKRHGQGLMPGLVSHYGLPEGLGETSSGGGGVGNPWEDEMRIPCPNRQF

SEQ ID NO: 49969 - protein, 1066 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCDFFKRTRYYQIMPKYHAVRIREEERYPPPGSTLPTKKHWVTSWQTRDQYY

SEQ ID NO: 49970 - protein, 1051 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 49971 - protein, 1037 aa, Homo sapiens
MLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 49972 - protein, 294 aa, Homo sapiens
MIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNISECWGAA

SEQ ID NO: 49973 - protein, 1035 aa, Homo sapiens
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 49974 - protein, 231 aa, Homo sapiens [sequence omitted]

SEQ ID NO: 49975 - protein, 1161 aa, Homo sapiens
MTFGTVLLLSVLASYHGFNLDVEEPTIFQEDAGGFGQSVVQFGGSRLVVGAPLEVVAANQTGRLYDCAAATGMCQPIPLHIRPEAVNMSLGLTLAASTNGSRLLACGPTLHRVCGENSYSKGSCLLLGSRWEIIQTVPDATPECPHQEMDIVFLIDGSGSIDQNDFNQMKGFVQAVMGQFEGTDTLFALMQYSNLLKIHFTFTQFRTSPSQQSLVDPIVQLKGLTFTATGILTVVTQLFHHKNGARKSAKKILIVITDGQKYKDPLEYSDVIPQAEKAGIIRYAIGVGHAFQGPTARQELNTISSAPPQDHVFKVDNFAALGSIQKQLQEKIYAVEGTQSRASSSFQHEMSQEGFSTALTMDGLFLGAVGSFSWSGGAFLYPPNMSPTFINMSQENVDMRDSYLGYSTELALWKGVQNLVLGAPRYQHTGKAVIFTQVSRQWRKKAEVTGTQIGSYFGASLCSVDVDSDGSTDLILIGAPHYYEQTRGGQVSVCPLPRGRVQWQCDAVLRGEQGHPWGRFGAALTVLGDVNEDKLIDVAIGAPGEQENRGAVYLFHGASESGISPSHSQRIASSQLSPRLQYFGQALSGGQDLTQDGLMDLAVGARGQVLLLRSLPVLKVGVAMRFSPVEVAKAVYRCWEEKPSALEAGDATVCLTIQKSSLDQLGDIQSSVRFDLALDPGRLTSRAIFNETKNPTLTRRKTLGLGIHCETLKLLLPDCVEDVVSPIILHLNFSLVREPIPSPQNLRPVLAVGSQDLFTASLPFEKNCGQDGLCEGDLGVTLSFSGLQTLTVGSSLELNVIVTVWNAGEDSYGTVVSLYYPAGLSHRRVSGAQKQPHQSALRLACETVPTEDEGLRSSRCSVNHPIFHEGSNGTFIVTFDVSYKATLGDRMLMRASASSENNKASSSKATFQLELPVKYAVYTMISRQEESTKYFNFATSDEKKMKEAEHRYRVNNLSQRDLAISINFWVPVLLNGVAVWDVVMEAPSQSLPCVSERKPPQHSDFLTQISRSPMLDCSIADCLQFRCDVPSFSVQEELDFTLKGNLSFGWVRETLQKKVLVVSVAEITFDTSVYSQLPGQEAFMRAQMEMVLEEDEVYNAIPIIMGSSVGALLLLALITATLYKLGFFKRHYKEMLEDKPEDTATFSGDDFSCVAPNVPLS

SEQ ID NO: 49976 - protein, 1177 aa, Homo sapiens
CALSPTFHFPSTRCSGMTFGTVLLLSVLASYHGFNLDVEEPTIFQEDAGGFGQSVVQFGGSRLVVGAPLEVVAANQTGRLYDCAAATGMCQPIPLHIRPEAVNMSLGLTLAASTNGSRLLACGPTLHRVCGENSYSKGSCLLLGSRWEIIQTVPDATPECPHQEMDIVFLIDGSGSIDQNDFNQMKGFVQAVMGQFEGTDTLFALMQYSNLLKIHFTFTQFRTSPSQQSLVDPIVQLKGLTFTATGILTVVTQLFHHKNGARKSAKKILIVITDGQKYKDPLEYSDVIPQAEKAGIIRYAIGVGHAFQGPTARQELNTISSAPPQDHVFKVDNFAALGSIQKQLQEKIYAVEGTQSRASSSFQHEMSQEGFSTALTMDGLFLGAVGSFSWSGGAFLYPPNMSPTFINMSQENVDMRDSYLGYSTELALWKGVQNLVLGAPRYQHTGKAVIFTQVSRQWRKKAEVTGTQIGSYFGASLCSVDVDSDGSTDLILIGAPHYYEQTRGGQVSVCPLPRGRVQWQCDAVLRGEQGHPWGRFGAALTVLGDVNEDKLIDVAIGAPGEQENRGAVYLFHGASESGISPSHSQRIASSQLSPRLQYFGQALSGGQDLTQDGLMDLAVGARGQVLLLRSLPVLKVGVAMRFSPVEVAKAVYRCWEEKPSALEAGDATVCLTIQKSSLDQLGDIQSSVRFDLALDPGRLTSRAIFNETKNPTLTRRKTLGLGIHCETLKLLLPDCVEDVVSPIILHLNFSLVREPIPSPQNLRPVLAVGSQDLFTASLPFEKNCGQDGLCEGDLGVTLSFSGLQTLTVGSSLELNVIVTVWNAGEDSYGTVVSLYYPAGLSHRRVSGAQKQPHQSALRLACETVPTEDEGLRSSRCSVNHPIFHEGSNGTFIVTFDVSYKATLGDRMLMRASASSENNKASSSKATFQLELPVKYAVYTMISRQEESTKYFNFATSDEKKMKEAEHRYRVNNLSQRDLAISINFWVPVLLNGVAVWDVVMEAPSQSLPCVSERKPPQHSDFLTQISRSPMLDCSIADCLQFRCDVPSFSVQEELDFTLKGNLSFGWVRETLQKKVLVVSVAEITFDTSVYSQLPGQEAFMRAQMEMVLEEDEVYNAIPIIMGSSVGALLLLALITATLYKLGFFKRHYKEMLEDKPEDTATFSGDDFSCVAPNVPLS

SEQ ID NO: 49977 - protein, 1170 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 49978 - protein, 1086 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 49979 - protein, 404 aa, Homo sapiens
MKDSCITVMAMALLSGFFFFAPASSYNLDVRGARSFSPPRAGRHFGYRVLQIKSLIPQFQGRLVANLTYTLQLDGHRTRRRGLFPGGRHELRRNIAVTTSMSCTDFSFHFPMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 49980 - protein, 162 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQVCCCSVFHKLQNRI

SEQ ID NO: 49981 - protein, 1152 aa, Homo sapiens
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 49982 - protein, 1153 aa, Homo sapiens
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGQRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 49983 - protein, 1163 aa, Homo sapiens
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 49984 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 49985 - protein, 1805 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 49986 - protein, 1805 aa, Homo sapiens; identical to SEQ ID NO: 49985

SEQ ID NO: 49987 - protein, 643 aa, Homo sapiens
GGIEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLAL

SEQ ID NO: 49988 - protein, 788 aa, Homo sapiens
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 49989 - protein, 788 aa, Homo sapiens; identical to SEQ ID NO: 49988

SEQ ID NO: 49990 - protein, 798 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 49991 - protein, 650 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 49992 - protein, 798 aa, Homo sapiens; identical to SEQ ID NO: 49990

SEQ ID NO: 49993 - protein, 401 aa, Homo sapiens
MNLVAVMGAFNKGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 49994 - protein, 494 aa, Homo sapiens
MRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 49995 - protein, 402 aa, Homo sapiens
MSGCARPTTGAPVQAMVSVTGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 49996 - protein, 353 aa, Homo sapiens
MCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 49997 - protein, 353 aa, Homo sapiens; identical to SEQ ID NO: 49996

SEQ ID NO: 49998 - protein, 317 aa, Homo sapiens
MKTALILLSILGMACAFSMKNLHRRVKIEDSEENGVFKYRPRYYLYKHAYFYPHLKRFPVQGSSDSSEENGDDSSEEEEEEEETSNEGENNEESNEDEDSEAENTTLSATTLGYGEDATPGTGYTGLAAIQLPKKAGDITNKATKEKESDEEEEEEEEGNENEESEAEVDENEQGINGTSTNSTEAENGNGSSGGDNGEEGEEESVTGANAEDTTETGRQGKGTSKTTTSPNGGFEPTTPPQVYRTTSPPFGKTTTVEYEGEYEYTGANEYDNGYEIYESENGEPRGDNYRAYEDEYSYFKGQGYDGYDGQNYYHHQ

SEQ ID NO: 49999 - protein, 313 aa, Homo sapiens
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGSKAVYPEGDGNWANYNTFGSAEAATSDDYKNPGYYDIQAKDLGIWHVPNKSPMQHWRNSSLLRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHHCIGGGGYFPEASPQQCGDFSGFDWSGYGTHVGYSSSREITEAAVLLFYR

SEQ ID NO: 50000 - protein, 325 aa, Homo sapiens
MLSMLRTMTRLCFLLFFSVATSGCSAAAASSLEMLSREFETCAFSFSSLPRSCKEIKERCHSAGDGLYFLRTKNGVVYQTFCDMTSGGGGWTLVASVHENDMRGKCTVGDRWSSQQGNKADYPEGDGNWANYNTFGSAEAATSDDYKNPGYYDIQAKDLGIWHVPNKSPMQHWRNSALLRYRTNTGFLQRLGHNLFGIYQKYPVKYRSGKCWNDNGPAIPVVYDFGDAKKTASYYSPYGQREFVAGFVQFRVFNNERAANALCAGIKVTGCNTEHHCIGGGGFFPQGKPRQCGDFSAFDWDGYGTHVKSSCSREITEAAVLLFYR

SEQ ID NO: 50001 - protein, 911 aa, Homo sapiens
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVSRDKICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 50002 - protein, 623 aa, Homo sapiens
MNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 50003 - protein, 769 aa, Homo sapiens
MEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVSRDKICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 50004 - protein, 645 aa, Homo sapiens
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVSRDKICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSLHHPRAPERGHPVLQHQ

SEQ ID NO: 50005 - protein, 946 aa, Homo sapiens
MKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPNCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDPEKPEASMEVKGQKLIITRGLQKDYRTDLVFGTDVTCWFVHNSGKGFIDGHYKDYFVPQLYSFLKRP

SEQ ID NO: 50006 - protein, 885 aa, Homo sapiens
MVALSHLGSALQLGSLFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEGFSATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 50007 - protein, 670 aa, Homo sapiens [sequence omitted]

SEQ ID NO: 50008 - protein, 890 aa, Homo sapiens
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 50009 - protein, 658 aa, Homo sapiens
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEGGDSHTGEPRHVLPDQLPASSKPLLLCGRGSPLHHPNSGERRCPLLQHR

SEQ ID NO: 50010 - protein, 930 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPEASFSPRRGWNRQAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 50011 - protein, 914 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKIEETTMTTQTPACPSCSRSRAPAVPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 50012 - protein, 900 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 50013 - protein, 560 aa, Homo sapiens
MTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPGDKVGGGGRGD

SEQ ID NO: 50014 - protein, 888 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 50015 - protein, 956 aa, Homo sapiens
MLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLAFHPFDTGMDTWPGNVQGALKLAALKMQVHEGQ

SEQ ID NO: 50016 - protein, 742 aa, Homo sapiens
MRNYDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLAFHPFDTGMDTWPGNVQGALKLAALKMQVHEGQ

SEQ ID NO: 50017 - protein, 702 aa, Homo sapiens
MLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVRGFRREEQIFSNVMKFPFASILEL

SEQ ID NO: 50018 - protein, 695 aa, Homo sapiens
MLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPPNSVKKKQNKTKKRHGRDGVFPLHHLGIR

SEQ ID NO: 50019 - protein, 723 aa, Homo sapiens
DSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLAFHPFDTGMLGRGMSREL

SEQ ID NO: 50020 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 50021 - protein, 310 aa, Homo sapiens
MAPSSPRPALPALLVLLGALFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 50022 - protein, 275 aa, Homo sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 50023 - protein, 275 aa, Homo sapiens; identical to SEQ ID NO: 50022

SEQ ID NO: 50024 - protein, 275 aa, Homo sapiens; identical to SEQ ID NO: 50022

SEQ ID NO: 50025 - protein, 275 aa, Homo sapiens; identical to SEQ ID NO: 50022

SEQ ID NO: 50026 - protein, 275 aa, Homo sapiens; identical to SEQ ID NO: 50022

SEQ ID NO: 50027 - protein, 547 aa, Homo sapiens
MATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 50028 - protein, 272 aa, Homo sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYSVPGGLLGGDPEAWKPGHLFRKPGALHRPGSGQRDLDLRVCCWTPRLLAARDLPRAPQSRRPGGPQQLGTHYTDARLEPRAHSFGLRFHRCPCRDPPHCGRCVPMQVPSYEVPGVKGDVLCRLSEKKRNMKQSGEMAIHGG

SEQ ID NO: 50029 - protein, 271 aa, Homo sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLAWSPAPTALASGSIAALVGILLTVGAAYLCKCLAMKSQA

SEQ ID NO: 50030 - protein, 237 aa, Homo sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLGEAPL

SEQ ID NO: 50031 - protein, 924 aa, Homo sapiens
MPGPSPGLRRALLGLWAALGLGLFGLSAVSQEPFWADLQPRVAFVERGGSLWLNCSTNCPRPERGGLETSLRRNGTQRGLRWLARQLVDIREPETQPVCFFRCARRTLQARGLIRTFQRPDRVELMPLPPWQPVGENFTLSCRVPGAGPRASLTLTLLRGAQELIRRSFAGEPPRARGAVLTATVLARREDHGANFSCRAELDLRPHGLGLFENSSAPRELRTFSLSPDAPRLAAPRLLEVGSERPVSCTLDGLFPASEARVYLALGDQNLSPDVTLEGDAFVATATATASAEQEGARQLVCNVTLGGENRETRENVTIYSFPAPLLTLSEPSVSEGQMVTVTCAAGAQALVTLEGVPAAVPGQPAQLQLNATENDDRRSFFCDATLDVDGETLIKNRSAELRVLYAPRLDDSDCPRSWTWPEGPEQTLRCEARGNPEPSVHCARSDGGAVLALGLLGPVTRALSGTYRCKAANDQGEAVKDVTLTVEYAPALDSVGCPERITWLEGTEASLSCVAHGVPPPDVICVRSGELGAVIEGLLRVAREHAGTYRCEATNPRGSAAKNVAVTVEYGPRFEEPSCPSNWTWVEGSGRLFSCEVDGKPQPSVKCVGSGGATEGVLLPLAPPDPSPRAPRIPRVLAPGIYVCNATNRHGSVAKTVVVSAESPPEMDESTCPSHQTWLEGAEASALACAARGRPSPGVRCSREGIPWPEQQRVSREDAGTYHCVATNAHGTDSRTVTVGVEYRPVVAELAASPPGGVRPGGNFTLTCRAEAWPPAQISWRAPPGALNIGLSSNNSTLSVAGAMGSHGGEYECAATNAHGRHARRITVRVAGPWLWVAVGGAAGGAALLAAGAGLAFYVQSTACKKGEYNVQEAESSGEAVCLNGAGGGAGGAAGAEGGPEAAGGAAESPAEGEVFAIQLTSA

SEQ ID NO: 50032 - protein, 557 aa, Homo sapiens
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAAKVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 50033 - protein, 488 aa, Homo sapiens
MDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAAKVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 50034 - protein, 496 aa, Homo sapiens
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDENDAVCEYFSEQPLKNLLLSTSEEQIEKCFIIENISTIATVEETNQTDEDHKKYSSQTSQDSGNYSNEDESESKTSEELQQDFV

SEQ ID NO: 50035 - protein, 515 aa, Homo sapiens [sequence omitted]

SEQ ID NO: 50036 - protein, 515 aa, Homo sapiens [sequence omitted]

SEQ ID NO: 50037 - protein, 331 aa, Homo sapiens
MLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKIGGIITVFLIALVLTSTIVTLKWIGYICLRNSLPKVLRQGLAKGWNAVAIHRCSHNALQSETPELKQSSCLSFPSSWDYKRASLCPSD

SEQ ID NO: 50038 - protein, 331 aa, Homo sapiens; identical to SEQ ID NO: 50037

SEQ ID NO: 50039 - protein, 186 aa, Homo sapiens
MLLKSPENSLLQFQFKYGVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIKRSCAFSLFSFFI

SEQ ID NO: 50040 - protein, 489 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 50041 - protein, 161 aa, Homo sapiens
MLLKSPENSLLQFQFKYGVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRV

SEQ ID NO: 50042 - protein, 274 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFCLAWYSSVFILRKLIH

SEQ ID NO: 50043 - protein, 210 aa, Homo sapiens
MALLFLLPLVMQGVSRAEMGTADLGPSSVPTPTNVTIESYNMNPIVYWEYQIMPQVPVFTVEVKNYGVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIK

SEQ ID NO: 50044 - protein, 461 aa, Homo sapiens
MPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 50045 - protein, 337 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 50046 - protein, 125 aa, Homo sapiens
MHKEEHEVAVLGPPPSTILPRSTVINIHSETSVPDHVVWSLFNTLFLNWCCLGFIAFAYSVKSRDRKMVGDVTGAQAYASTAKCLNIWALILGILMTIGFILLLVFGSVTVYHIMLQIIQEKRGY

SEQ ID NO: 50047 - protein, 125 aa, Homo sapiens; identical to SEQ ID NO: 50046

SEQ ID NO: 50048 - protein, 99 aa, Homo sapiens
PQSQKMHKEEHEVAVLGPPPSTILPRSTVINIHSETSVPDHVVVPVQHPLLECCLGFIAFAYSVKSRDRKMVGDVTGAQALHRQVPEHLGPDSGHPHDH

SEQ ID NO: 50049 - protein, 125 aa, Homo sapiens; identical to SEQ ID NO: 50046

SEQ ID NO: 50050 - protein, 164 aa, Homo sapiens
MNHIVQTFSPVNSGQPPNYEMLKEEQEVAMLGVPHNPAPPMSTVIHIRSETSVPDHVVVPVQHPLHECCLGFIAFAYSVKSRDRKMVGDVTGAQALHRQVPEHLGPDFGHLHDHSAHHHPSVGRPGPAIDQEASLRPGALPVTCIPRTLSSIPRPAPRGQELCP

SEQ ID NO: 50051 - protein, 132 aa, Homo sapiens
MNHIVQTFSPVNSGQPPNYEMLKEEQEVAMLGVPHNPAPPMSTVIHIRSETSVPDHVVWSLFNTLFMNTCCLGFIAFAYSVKSRDRKMVGDVTGAQAYASTAKCLNIWALILGIFMTILLIIIPVLVVQAQR

SEQ ID NO: 50052 - protein, 148 aa, Homo sapiens
PPNYEMLKEEHEVAVLGAPHNPAPPTSTVIHIRSETSVPDHVVVPVQHPLHECCLGFIAFAYSVKSRDRKMVGDVTGAQALHRQVPEHLGPDSGHPHDHSAHRHPSADLPGLWIDQEASLRPGALPMTCIPRTPTSIPRPAPGAESCI

SEQ ID NO: 50053 - protein, 133 aa, Homo sapiens
MNHTVQTFFSPVNSGQPPNYEMLKEEHEVAVLGAPHNPAPPTSTVIHIRSETSVPDHVVWSLFNTLFMNPCCLGFIAFAYSVKSRDRKMVGDVTGAQAYASTAKCLNIWALILGILMTILLIVIPVLIFQAYG

SEQ ID NO: 50054 - protein, 1025 aa, Homo sapiens
MSNGYSTDENFRYLISCFRARVKMYIQVEPVLDYLTFLPAEVKEQIQRTVATSGNMQAVELLLSTLEKGVWHLGWTREFVEALRRTGSPLAARYMNPELTDLPSPSFENAHDEYLQLLNLLQPTLVDKLLVRDVLDKCMEEELLTIEDRNRIAAAENNGNESGVRELLKRIVQKENWFSAFLNVLRQTGNNELVQELTGSDCSESNAEIENLSQVDGPQVEEQLLSTTVQPNLEKEVWGMENNSSESSFADSSVVSESDTSLAEGSVSCLDESLGHNSNMGSDSGTMGSDSDEENVAARASPEPELQLRPYQMEVAQPALEGKNIIICLPTGSGKTRVAVYIAKDHLDKKKKASEPGKVIVLVNKVLLVEQLFRKEFQPFLKKWYRVIGLSGDTQLKISFPEVVKSCDIIISTAQILENSLLNLENGEDAGVQLSDFSLIIIDECHHTNKEAVYNNIMRHYLMQKLKNNRLKKENKPVIPLPQILGLTASPGVGGATKQAKAEEHILKLCANLDAFTIKTVKENLDQLKNQIQEPCKKFAIADATREDPFKEKLLEIMTRIQTYCQMSPMSDFGTQPYEQWAIQMEKKAAKEGNRKERVCAEHLRKYNEALQINDTIRMIDAYTHLETFYNEEKDKKFAVIEDDSDEGGDDEYCDGDEDEDDLKKPLKLDETDRFLMTLFFENNKMLKRLAENPEYENEKLTKLRNTIMEQYTRTEESARGIIFTKTRQSAYALSQWITENEKFAEVGVKAHHLIGAGHSSEFKPMTQNEQKEVISKFRTGKINLLIATTVAEEGLDIKECNIVIRYGLVTNEIAMVQARGRARADESTYVLVAHSGSGVIEHETVNDFREKMMYKAIHCVQNMKPEEYAHKILELQMQSIMEKKMKTKRNIAKHYKNNPSLITFLCKNCSVLACSGEDIHVIEKMHHVNMTPEFKELYIVRENKALQKKCADYQINGEIICKCGQAWGTMMVHKGLDLPCLKIRNFVVVFKNNSTKKQYKKWVELPITFPNLDYSECCLFSDED

SEQ ID NO: 50055 - protein, 221 aa, Homo sapiens
MSNGYSTDENFRYLISCFRARVKMYIQVEPVLDYLTFLPAEVKEQIQRTVATSGNMQAVELLLSTLEKGVWHLGWTREFVEALRRTGSPLAARYMNPELTDLPSPSFENAHDEYLQLLNLLQPTLVDKLLVRDVLDKCMEEELLTIEDRNRIAAAENNGNESGVRELLKRIVQKENWFSAFLNVLRQTGNNELVQELTGSDCSESNAGICNFTEEDSSNSA

SEQ ID NO: 50056 - protein, 1025 aa, Homo sapiens; identical to SEQ ID NO: 50054

SEQ ID NO: 50057 - protein, 349 aa, Homo sapiens
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNIIVVGQSHLDSNIENQEIVTNPPDICQVVEVTTESDEQPVSMSELYPLQISPVSSYAESETTDSVPSDEESAEGRPHWRKRNIEGKQYLSNMGTRGSYLLPGMASFVTSNKPDLQVTIKEESNPVPYNSSWPPFQDLPLSSSMTPASSSSRPDRETRASVIKKTSDITQARVKSC

SEQ ID NO: 50058 - protein, 137 aa, Homo sapiens
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIK

SEQ ID NO: 50059 - protein, 137 aa, Homo sapiens; identical to SEQ ID NO: 50058

SEQ ID NO: 50060 - protein, 176 aa, Homo sapiens
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNII

SEQ ID NO: 50061 - protein, 161 aa, Homo sapiens
MPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVL

SEQ ID NO: 50062 - protein, 427 aa, Homo sapiens
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 50063 - protein, 300 aa, Homo sapiens
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 50064 - protein, 427 aa, Homo sapiens; identical to SEQ ID NO: 50062

SEQ ID NO: 50065 - protein, 104 aa, Homo sapiens
MGTPKPRILPWLVSQLDLGQLEGVAWVNKSRTRFRIPWKHGLRQDAQQEDFGIFQELGTFPSQTPLRTPMVEAVLLIPRKTFWMSYWVTWCWPHSQIRDPQAWL

SEQ ID NO: 50066 - protein, 281 aa, Homo sapiens
MVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 50067 - protein, 154 aa, Homo sapiens
MVLAPLPDPGPPSLAVAPEPCPQPLRSPSLDNPTPFPNLGPSENPLKRLLVPGEDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 50068 - protein, 281 aa, Homo sapiens; identical to SEQ ID NO: 50066

SEQ ID NO: 50069 - protein, 300 aa, Homo sapiens; identical to SEQ ID NO: 50063

SEQ ID NO: 50070 - protein, 154 aa, Homo sapiens; identical to SEQ ID NO: 50067

SEQ ID NO: 50071 - protein, 467 aa, Homo sapiens
MALHPRRVRLKPWLVAQVDSGLYPGLIWLHRDSKRFQIPWKHATRHSPQQEEENTIFKAWAVETGKYQEGVDDPDPAKWKAQLRCALNKSREFNLMYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAPNLIERQKKVKLFCLETFLSDLIAHQKGQIEKQPPFEIYLCFGEEWPDGKPLERKLILVQVIPVVARMIYEMFSGDFTRSFDSGSVRLQISTPDIKDNIVAQLKQLYRILQTQESWQPMQPTPSMQLPPALPPQ

SEQ ID NO: 50072 - protein, 276 aa, Homo sapiens
MALHPRRVRLKPWLVAQVDSGLYPGLIWLHRDSKRFQIPWKHATRHSPQQEEENTIFKAWAVETGKYQEGVDDPDPAKWKAQLRCALNKSREFNLMYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKF

SEQ ID NO: 50073 - protein, 372 aa, Homo sapiens
MYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAPNLIERQKKVKLFCLETFLSDLIAHQKGQIEKQPPFEIYLCFGEEWPDGKPLERKLILVQVIPVVARMIYEMFSGDFTRSFDSGSVRLQISTPDIKDNIVAQLKQLYRILQTQESWQPMQPTPSMQLPPALPPQ

SEQ ID NO: 50074 - protein, 426 aa, Homo sapiens
MCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCKLGVATAGCVNEVTEMECGRSEIDELIKEPSVDDYMGMIKRSPSPPEACRSQLLPDWWAQQPSTGVPLVTGYTTYDAHHSAFSQMVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQITV

SEQ ID NO: 50075 - protein, 181 aa, Homo sapiens
MAGSREVVAMDCEMVGLGPHRESGLARCSLVNVHGAVLYDKFIRPEGEITDYRTRVSGVTPQHMVGATPFAVARLEILQLLKGKLVVGHDLKHDFQALKEDMSGYTIYDTSTDRLLWREAKLDHCRRVSLRVLSERLLHKSIQNSLLGHSSVEDARATMELYQISQRIRARRGLPRLAVSD

SEQ ID NO: 50076 - protein, 181 aa, Homo sapiens; identical to SEQ ID NO: 50075

SEQ ID NO: 50077 - protein, 353 aa, Homo sapiens
MSTLLLNLDFGEPPPKKALEGNAKHRNFVKKRRLLERRGFLSKKNQPPSKAPKLHSEPSKKGETPTVDGTWKTPSFPKKKTAASSNGSGQPLDKKAAVSWLTPAPSKKADSVAAKVDLLGEFQSALPKINSHPTRSQKKSSQKKSSKKNHPQKNAPQNSTQAHSENKCSGASQKLPRKMVAIDCEMVGTGPKGHVSSLARCSIVNYNGDVLYDEYILPPCHIVDYRTRWSGIRKQHMVNATPFKIARGQILKILTGKIVVGHAIHNDFKALQYFHPKSLTRDTSHIPPLNRKADCPENATMSLKHLTKKLLNRDIQVGKSGHSSVEDAQATMELYKLVEVEWEEHLARNPPTD

SEQ ID NO: 50078 - protein, 353 aa, Homo sapiens; identical to SEQ ID NO: 50077

SEQ ID NO: 50079 - protein, 119 aa, Homo sapiens
MEASALTSSAVTSVAKVVRVASGSAVVLPLARIATVVIGGVVAVPMVLSAMGFTAAGIASSSIAAKMMSAAAIANGGGVASGSLVATLQSLGATGLSGLTKFILGSIGSAIAAVIARFY

SEQ ID NO: 50080 - protein, 122 aa, Homo sapiens
MEASALTSSAVTSVAKVVRVASGSAVVLPLARIATVVIGGGESVVAVPMVLSAMGFTAAGIASSSIAAKMMSAAAIANGGGVASGSLVATLQSLGATGLSGLTKFILGSIGSAIAAVIARFY

SEQ ID NO: 50081 - protein, 122 aa, Homo sapiens
MEASALTSSAVTSVAKVVRVASGSAVVLPLARIATVVIGGVASIVAVPMVLSAMGFTAAGIASSSIAAKMMSAAAIANGGGVASGSLVATLQSLGATGLSGLTKFILGSIGSAIAAVIARFY

SEQ ID NO: 50082 - protein, 62 aa, Homo sapiens
MEASALTSSAVTSVAKVVRVASGSAVVLPLARIATVVIGGVVAVPMVLSAMGFTAAGIASSS

SEQ ID NO: 50083 - protein, 57 aa, Homo sapiens
MEASALTSSAVTSVAKVVRVASGSAVVLPLARIATVVIGGVVAVPMVLSAMGFTAAG

SEQ ID NO: 50084 - protein, 119 aa, Homo sapiens; identical to SEQ ID NO: 50079

SEQ ID NO: 50085 - protein, 40 aa, Homo sapiens
MEASALTSSAVTSVAKVVRVASGSAVVLPLARIATVVIGG

SEQ ID NO: 50086 - protein, 93 aa, Homo sapiens
MEASALTSSAVTSVAKVVRVASGSAVVLPLARIATVVIGGVVAVPMVLSAMGFTAAGIASSSIAAKMMSAAAIANGGGVASGSLVATLQSLGA

SEQ ID NO: 50087 - protein, 785 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 50088 - protein, 673 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 50089 - protein, 414 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 50090 - protein, 729 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 50091 - protein, 729 aa, Homo sapiens; identical to SEQ ID NO: 50090

SEQ ID NO: 50092 - protein, 127 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQ

SEQ ID NO: 50093 - protein, 733 aa, Homo sapiens
MSVKMGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQNPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 50094 - protein, 180 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVDATSPAPSTSSTVKTEGAEATPGAQKRKKSTKEKAGPKGSKVSEEQTQPPSPAGAGMSTAMGRSPSPKTSLSAPPNSS

SEQ ID NO: 50095 - protein, 494 aa, Homo sapiens
  MOD_RES (1)..(1): Any amino acid
XSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKKNVRGEFTYYEIQDNTGKMEVVVHGRLTTINCEEGDKLKLTCFELAPKSGNTGELRSVIHSHIKVIKTRKNKKDILNPDSSMETSPDFFF

SEQ ID NO: 50096 - protein, 250 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 50097 - protein, 195 aa, Homo sapiens
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 50098 - protein, 286 aa, Homo sapiens
MSAPLDAALHALQEEQARLKMRLWDLQQLRKELGDSPKDKVPFSVPKIPLVFRGHTQQDPEVPKSLVSNLRIHCPLLAGSALITFDDPKVAEQVLQQKEHTINMEECRLRVQVQPLELPMVTTIQMSSQLSGRRVLVTGFPASLRLSEEELLDKLEIFFGKTRNGGGDVDVRELLPGSVMLGFARDGVAQRLCQIGQFTVPLGGQQVPLRVSPYVNGEIQKAEIRSQPVPRSVLVLNIPDILDGPELHDVLEIHFQKPTRGGGEVEALTVVPQGQQGLAVFTSESG

SEQ ID NO: 50099 - protein, 288 aa, Homo sapiens
MSAPLDAALHALQEEQARLKMRLWDLQQLRKELGDSPKDKVPFSVPKIPLVFRGHTQQDPEVPKSLVSNLRIHCPLLAGSALITFDDPKVAEQVLQQKEHTINMEECRLRVQVQPLELPMVTTIQVMMSSQLSGRRVLVTGFPASLRLSEEELLDKLEIFFGKTRNGGGDVDVRELLPGSVMLGFARDGVAQRLCQIGQFTVPLGGQQVPLRVSPYVNGEIQKAEIRSQPVPRSVLVLNIPDILDGPELHDVLEIHFQKPTRGGGEVEALTVVPQGQQGLAVFTSESG

SEQ ID NO: 50100 - protein, 444 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKLEEVQRKLGFALSDISVVSNYSSEWELDPVKDVLILSALRRMLWAADDFLEDLPFEQIGNLREEIINCAQGKK

SEQ ID NO: 50101 - protein, 195 aa, Homo sapiens
MDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYF

SEQ ID NO: 50102 - protein, 76 aa, Homo sapiens
  MOD_RES (1)..(1): Any amino acid
XLSDISVVSNYSSEWELDPVKDVLILSALRRMLWAADDFLEDLPFEQIGRWFGGVEAWKRSGNLREEIINCAQGKK

SEQ ID NO: 50103 - protein, 129 aa, Homo sapiens
MESIKLNHHDYIDSPSLKDRIHCVAFVFDASSIQYFSSQMIVKIKRIRRELVNAGVVHVALLTHVDSMDLITKGDLIEIERCEPVRSKVMNDALRKHIFWGMLLQSHTSVYKNKNKQLLGLRRITKLLK

SEQ ID NO: 50104 - protein, 194 aa, Homo sapiens
MLCDTMGLDGAEGAGLCMDDIPHILKGCMPDRYQFNSRKPITPEHSTFITSPSLKDRIHCVAYVLDINSIDNLYSKMLAKVKQVHKEVLNCGIAYVALLTKVDDCSEVLQDNFLNMSRSMTSQSRVMNVHKMLGIPISNILMVGNYASDLELDPMKDILILSALRQMLRAADDFLEDLPLEETGAIERALQPCI

SEQ ID NO: 50105 - protein, 452 aa, Homo sapiens
MEVTTRLTWNDENHLRKLLGNVSLSLLYKSSVHGGSIEDMVERCSRQGCTITMAYIDYNMIVAFMLGNYINLHESSTEPNDSLWFSLQKKNDTTEIETLLLNTAPKIIDEQLVCRLSKTDIFIICRDNKIYLDKMITRNLKLRFYGHRQYLECEVFRVEGIKDNLDDIKRIIKAREHRNRLLADIRDYRPYADLVSEIRILLVGPVGSGKSSFFNSVKSIFHGHVTGQAVVGSDITSITERYRIYSVKDGKNGKSLPFMLCDTMGLDGAEGAGLCMDDIPHILKGCMPDRYQFNSRKPITPEHSTFITSPSLKDRIHCVAYVLDINSIDNLYSKMLAKVKQVHKEVLNCGIAYVALLTKVDDCSEVLQDNFLNMSRSMTSQSRVMNVHKMLGIPISNILMVGNYASDLELDPMKDILILSALRQMLRAADDFLEDLPLEETGAIERALQPCI

SEQ ID NO: 50106 - protein, 97 aa, Homo sapiens
MEVTTRLTWNDENHLRKLLGNVSLSLLYKSSVHGGSIEDMVERCSRQGCTITMAYIDYNMIVAFMLGNYINLHESSTEPNDSLWFSLQKKNDTTEIE

SEQ ID NO: 50107 - protein, 478 aa, Homo sapiens
MSTNGDDHQVKDSLEQLRCHFTWELSIDDDEMPDLENRVLDQIEFLDTKYSVGIHNLLAYVKHLKGQNEEALKSLKEAENLMQEEHDNQANVRSLVTWGNFAWMYYHMGRLAEAQTYLDKVENICKKLSNPFRYRMECPEIDCEEGWALLKCGGKNYERAKACFEKVLEVDPENPESSAGYAISAYRLDGFKLATKNHKPFSLLPLRQAVRLNPDNGYIKVLLALKLQDEGQEAEGEKYIEEALANMSSQTYVFRYAAKFYRRKGSVDKALELLKKALQETPTSVLLHHQIGLCYKAQMIQIKEATKGQPRGQNREKLDKMIRSAIFHFESAVEKKPTFEVAHLDLARMYIEAGNHRKAEENFQKLLCMKPVVEETMQDIHFHYGRFQEFQKKSDVNAIIHYLKAIKIEQASLTRDKSINSLKKLVLRKLRRKALDLESLSLLGFVYKLEGNMNEALEYYERALRLAADFENSVRQGP

SEQ ID NO: 50108 - protein, 447 aa, Homo sapiens
MPDLENRVLDQIEFLDTKYSVGIHNLLAYVKHLKGQNEEALKSLKEAENLMQEEHDNQANVRSLVTWGNFAWMYYHMGRLAEAQTYLDKVENICKKLSNPFRYRMECPEIDCEEGWALLKCGGKNYERAKACFEKVLEVDPENPESSAGYAISAYRLDGFKLATKNHKPFSLLPLRQAVRLNPDNGYIKVLLALKLQDEGQEAEGEKYIEEALANMSSQTYVFRYAAKFYRRKGSVDKALELLKKALQETPTSVLLHHQIGLCYKAQMIQIKEATKGQPRGQNREKLDKMIRSAIFHFESAVEKKPTFEVAHLDLARMYIEAGNHRKAEENFQKLLCMKPVVEETMQDIHFHYGRFQEFQKKSDVNAIIHYLKAIKIEQASLTRDKSINSLKKLVLRKLRRKALDLESLSLLGFVYKLEGNMNEALEYYERALRLAADFENSVRQGP

SEQ ID NO: 50109 - protein, 472 aa, Homo sapiens
MSENNKNSLESSLRQLKCHFTWNLMEGENSLDDFEDKVFYRTEFQNREFKATMCNLLAYLKHLKGQNEAALECLRKAEELIQQEHADQAEIRSLVTWGNYAWVYYHMGRLSDVQIYVDKVKHVCEKFSSPYRIESPELDCEEGWTRLKCGGNQNERAKVCFEKALEKKPKNPEFTSGLAIASYRLDNWPPSQNAIDPLRQAIRLNPDNQYLKVLLALKLHKMREEGEEEGEGEKLVEEALEKAPGVTDVLRSAAKFYRRKDEPDKAIELLKKALEYIPNNAYLHCQIGCCYRAKVFQVMNLRENGMYGKRKLLELIGHAVAHLKKADEANDNLFRVCSILASLHALADQYEDAEYYFQKEFSKELTPVAKQLLHLRYGNFQLYQMKCEDKAIHHFIEGVKINQKSREKEKMKDKLQKIAKMRLSKNGADSEALHVLAFLQELNEKMQQADEDSERGLESGSLIPSASSWNGE

SEQ ID NO: 50110 - protein, 451 aa, Homo sapiens
MPKNKKRNTPHRGSSAGGGGSGAAAATAATAGGQHRNVQPFSDEDASIETMSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKIICDGSASMQARQTCATCFGVCCFIATDDITELYSTLECLENIFTKSYLKEKDTTVICSTPNTVLHISSLLAWTLLLTICPINEVKKKLEMHFHKLPSLLSCDDVNMRIAAGESLALLFELARGIESDFFYEDMESLTQMLRALATDGNKHRAKVDKRKQRSVFRDVLRAVEERDFPTETIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 50111 - protein, 451 aa, Homo sapiens; identical to SEQ ID NO: 50110

SEQ ID NO: 50112 - protein, 18 aa, Homo sapiens
MPKNKKRNTPHRGSSAGG

SEQ ID NO: 50113 - protein, 31 aa, Homo sapiens
MPKNKKRNTPHRGSSAGGGGSGAAAATAATA

SEQ ID NO: 50114 - protein, 62 aa, Homo sapiens
MPKNKKRNTPHRGSSAGGGGSGAAAATAATAGGQHRNVQPFSDEDASIETMSHCSGYSDPSS

SEQ ID NO: 50115 - protein, 401 aa, Homo sapiens
MSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKIICDGSASMQARQTCATCFGVCCFIATDDITELYSTLECLENIFTKSYLKEKDTTVICSTPNTVLHISSLLAWTLLLTICPINEVKKKLEMHFHKLPSLLSCDDVNMRIAAGESLALLFELARGIESDFFYEDMESLTQMLRALATDGNKHRAKVDKRKQRSVFRDVLRAVEERDFPTETIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 50116 - protein, 157 aa, Homo sapiens
MHFHKLPSLLSCDDVNMRIAAGESLALLFELARGIESDFFYEDMESLTQMLRALATDGNKHRAKVDKRKQRSVFRDVLRAVEERDFPTETIKFGPERMYIDCWVKKHTYDTFKEVLGSGMQYHLQSNEFLRNVFELGPPVMLDAATLKTMKISRFER

SEQ ID NO: 50117 - protein, 608 aa, Homo sapiens
MGPKKSWRSHFFPLPEVWLLLLLSQALSPSHGPQTQAGVGLVWSVPLPSALRSQSCLGAPLRDASELTTVHLFPTRGWGARRALWVHSSASASSAASRRRLRAQASGISSFSLVDGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 50118 - protein, 442 aa, Homo sapiens
MPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 50119 - protein, 506 aa, Homo sapiens
MAWNSPSRRPVWQGGAPREDGGARGVWLPSSGQVSAQRTGRRLVGLEPTPTGSLTPRPPRPVPGMPRARKGNTLRKGGQRRGGGARSSAQADSGSSDDEAASEARSTASECPSLLSTTAEDSLGGDVVDEQGQQEDLEEKLKEYVDCLTDKSAKTRQGALESLRLALASRLLPDFLLERRLTLADALEKCLKKGKGEEQALAAAVLGLLCVQLGPGPKGEELFHSLQPLLVSVLSDSTASPAARLHCASALGLGCYVAAADIQDLVSCLACLESVFSRFYGLGGSSTSPVVPASLHGLLSAALQAWALLLTICPSTQISHILDRQLPRLPQLLSSESVNLRIAAGETIALLFELARDLEEEFVYEDMEALCSVLRTLATDSNKYRAKADRRRQRSTFRAVLHSVEGGECEEEIVRFGFEVLYMDSWARHRIYAAFKEVLGSGMHHHLQNNELLRDIFGLGPVLLLDATALKACKVPRFEKHLYNAAAFKARTKARSRVRDKRADIL

SEQ ID NO: 50120 - protein, 442 aa, Homo sapiens; identical to SEQ ID NO: 50118

SEQ ID NO: 50121 - protein, 570 aa, Homo sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGIVTDETLSFIQKSRRLLVVLSPNYVLQGTQALLELKAGLENMASRGNINVILVQYKAVKETKVKELKRAKTVLTVIKWKGEKSKYPQGRFWKQLQVAMPVKKSPRRSSSDEQGLSYSSLKNV

SEQ ID NO: 50122 - protein, 687 aa, Homo sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGNTVEAVFDFIQRSRRMIVVLSPDYVTEKSISMLEFKLGVMCQNSIATKLIVVEYRPLEHPHPGILQLKESVSFVSWKGEKSKHSGSKFWKALRLALPLRSLSASSGWNESCSSQSDISLDHVQRRRSRLKEPPELQSSERAAGSPPAPGTMSKHRGKSSATCRCCVTYCEGENHLRNKSRAEIHNQPQWETHLCKPVPQESETQWIQNGTRLEPPAPQISALALHHFTDLSNNNDFYIL

SEQ ID NO: 50123 - protein, 570 aa, Homo sapiens; identical to SEQ ID NO: 50121

SEQ ID NO: 50124 - protein, 356 aa, Homo sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKGNRCGQ

SEQ ID NO: 50125 - protein, 113 aa, Homo sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYT

SEQ ID NO: 50126 - protein, 356 aa, Homo sapiens; identical to SEQ ID NO: 50124

SEQ ID NO: 50127 - protein, 570 aa, Homo sapiens; identical to SEQ ID NO: 50121

SEQ ID NO: 50128 - protein, 687 aa, Homo sapiens; identical to SEQ ID NO: 50122

SEQ ID NO: 50129 - protein, 570 aa, Homo sapiens; identical to SEQ ID NO: 50121

SEQ ID NO: 50130 - protein, 145 aa, Homo sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLP

SEQ ID NO: 50131 - protein, 696 aa, Homo sapiens
MKAPIPHLILLYATFTQSLKVVTKRGSADGCTDWSIDIKKYQVLVGEPVRIKCALFYGYIRTNYSLAQSAGLSLMWYKSSGPGDFEEPIAFDGSRMSKEEDSIWFRPTLLQDSGLYACVIRNSTYCMKVSISLTVGENDTGLCYNSKMKYFEKAELSKSKEISCRDIEDFLLPTREPEILWYKECRTKTWRPSIVFKRDTLLIREVREDDIGNYTCELKYGGFVVRRTTELTVTAPLTDKPPKLLYPMESKLTIQETQLGDSANLTCRAFFGYSGDVSPLIYWMKGEKFIEDLDENRVWESDIRILKEHLGEQEVSISLIVDSVEEGDLGNYSCYVENGNGRRHASVLLHKRELMYTVELAGGLGAILLLLVCLVTIYKCYKIEIMLFYRNHFGAEELDGDNKDYDAYLSYTKVDPDQWNQETGEEERFALEILPDMLEKHYGYKLFIPDRDLIPTGTYIEDVARCVDQSKRLIIVMTPNYVVRRGWSIFELETRLRNMLVTGEIKVILIECSELRGIMNYQEVEALKHTIKLLTVIKWHGPKCNKLNSKFWKRLQYEMPFKRIEPITHEQALDVSEQGPFGELQTVSAISMAAATSTALATAHPDLRSTFHNTYHSQMRQKHYYRSYEYDVPPTGTLPLTSIGNQHTYCNIPMTLINGQRPQTKSSREQNPDEAHTNSAILPLLPRETSISSVIW

SEQ ID NO: 50132 - protein, 696 aa, Homo sapiens; identical to SEQ ID NO: 50131

SEQ ID NO: 50133 - protein, 686 aa, Homo sapiens
MKPPFLLALVVCSVVSTNLKMVSKRNSVDGCIDWSVDLKTYMALAGEPVRVKCALFYSYIRTNYSTAQSTGLRLMWYKNKGDLEEPIIFSEVRMSKEEDSIWFHSAEAQDSGFYTCVLRNSTYCMKVSMSLTVAENESGLCYNSRIRYLEKSEVTKRKEISCPDMDDFKKSDQEPDVVWYKECKPKMWRSIIIQKGNALLIQEVQEEDGGNYTCELKYEGKLVRRTTELKVTALLTDKPPKPLFPMENQPSVIDVQLGKPLNIPCKAFFGFSGESGPMIYWMKGEKFIEELAGHIREGEIRLLKEHLGEKEVELALIFDSVVEADLANYTCHVENRNGRKHASVLLRKKDLIYKIELAGGLGAIFLLLVLLVVIYKCYNIELMLFYRQHFGADETNDDNKEYDAYLSYTKVDQDTLDCDNPEEEQFALEVLPDVLEKHYGYKLFIPERDLIPSGTYMEDLTRYVEQSRRLIIVLTPDYILRRGWSIFELESRLHNMLVSGEIKVILIECTELKGKVNCQEVESLKRSIKLLSLIKWKGSKSSKLNSKFWKHLVYEMPIKKKEMLPRCHVLDSAEQGLFGELQPIPSIAMTSTSATLVSSQADLPEFHPSDSMQIRHCCRGYKHEIPATTLPVPSLGNHHTYCNLPLTLLNGQLPLNNTLKDTQEFHRNSSLLPLSSKELSFTSDIW

SEQ ID NO: 50134 - protein, 686 aa, Homo sapiens; identical to SEQ ID NO: 50133

SEQ ID NO: 50135 - protein, 291 aa, Homo sapiens [sequence omitted]

SEQ ID NO: 50136 - protein, 398 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 50137 - protein, 398 aa, Homo sapiens; identical to SEQ ID NO: 50136

SEQ ID NO: 50138 - protein, 229 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIK

SEQ ID NO: 50139 - protein, 556 aa, Homo sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPIDHHSIYCIIAVCSVFLMLINVLVIILKMFWIEATLLWRDIAKPYKTRNDGKLYDAYVVYPRNYKSSTDGASRVEHFVHQILPDVLENKCGYTLCIYGRDMLPGEDVVTAVETNIRKSRRHIFILTPQITHNKEFAYEQEVALHCALIQNDAKVILIEMEALSELDMLQAEALQDSLQHLMKVQGTIKWREDHIANKRSLNSKFWKHVRYQMPVPSKIPRKASSLTPLAAQKQ

SEQ ID NO: 50140 - protein, 328 aa, Homo sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 50141 - protein, 259 aa, Homo sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKVWCQSFCKLKKSLIFSNTHWIQSLMRGFVMVYYGVHKCCRVVFNLCLQYFQHHQWP

SEQ ID NO: 50142 - protein, 211 aa, Homo sapiens
MYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 50143 - protein, 314 aa, Homo sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 50144 - protein, 38 aa, Homo sapiens
MGFWILAILTILMYSTAAKFSKQSWGLENEALIVRCPR

SEQ ID NO: 50145 - protein, 575 aa, Homo sapiens
MWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGERFTVLETRLLVSNVSAEDRGNYACQAILTHSGKQYEVLNGITVSITERAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFRAYLIGGLIALVAVAVSVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGLLKNLSEEQIAVYSALIQDGMKVILIELEKIEDYTVMPESIQYIKQKHGAIRWHGDFTEQSQCMKTKFWKTVRYHMPPRRCRPFPPVQLLQHTPCYRTAGPELGSRRKKCTLTTG

SEQ ID NO: 50146 - protein, 172 aa, Homo sapiens
MWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGER

SEQ ID NO: 50147 - protein, 457 aa, Homo sapiens
MTGLVSLSYFPLSTRSCALQSCSPVWGCGPCCSAGCPSPFHCLSQQDCNEIKGERFTVLETRLLVSNVSAEDRGNYACQAILTHSGKQYEVLNGITVSIKRAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFRAYLIGGLIALVAVAVSVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGLLKNLSEEQIAVYSALIQDGMKVILIELEKIEDYTVMPESIQYIKQKHGAIRWHGDFTEQSQCMKTKFWKTVRYHMPPRRCRPFPPVQLLQHTPCYRTAGPELGSRRKKCTLTTG

SEQ ID NO: 50148 - protein, 575 aa, Homo sapiens; identical to SEQ ID NO: 50145

SEQ ID NO: 50149 - protein, 578 aa, Homo sapiens
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 50150 - protein, 499 aa, Homo sapiens
MSRTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGPNGTVEPAH

SEQ ID NO: 50151 - protein, 558 aa, Homo sapiens
MSRTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 50152 - protein, 429 aa, Homo sapiens
MAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 50153 - protein, 422 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLWLRLRRGGKDGSPKPGFLASVIPVDRRPGAPNL

SEQ ID NO: 50154 - protein, 390 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLW

SEQ ID NO: 50155 - protein, 422 aa, Homo sapiens; identical to SEQ ID NO: 50153

SEQ ID NO: 50156 - protein, 422 aa, Homo sapiens; identical to SEQ ID NO: 50153

SEQ ID NO: 50157 - protein, 270 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWST

SEQ ID NO: 50158 - protein, 167 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGP

SEQ ID NO: 50159 - protein, 139 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISG

SEQ ID NO: 50160 - protein, 662 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 50161 - protein, 381 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTDGMISAHCNLRLPDSRDSPASASRVAGITGICHHTRLILYF

SEQ ID NO: 50162 - protein, 662 aa, Homo sapiens; identical to SEQ ID NO: 50160

SEQ ID NO: 50163 - protein, 862 aa, Homo sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 50164 - protein, 659 aa, Homo sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKRRHSCPWTGS

SEQ ID NO: 50165 - protein, 230 aa, Homo sapiens
  MOD_RES (1)..(1): Any amino acid
XQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKVSFKRQLKTQGNKTEG

SEQ ID NO: 50166 - protein, 659 aa, Homo sapiens; identical to SEQ ID NO: 50164

SEQ ID NO: 50167 - protein, 776 aa, Homo sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 50168 - protein, 226 aa, Homo sapiens
MSSPTASSTTPRCGTSAGPASPTWRCRATALHLHHPVDQLPHQVLQPTTGQRQPGTGLPWHSTPAQLALAGLRQAQPHPQQQRLHQPGLRGVDAHGSAAHVPQAVPQAVRAHPPGQLLSWAAAVCLLCQHHLQLPGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 50169 - protein, 279 aa, Homo sapiens
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVRF

SEQ ID NO: 50170 - protein, 427 aa, Homo sapiens
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 50171 - protein, 380 aa, Homo sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 50172 - protein, 380 aa, Homo sapiens; identical to SEQ ID NO: 50171

SEQ ID NO: 50173 - protein, 154 aa, Homo sapiens
MAPRRARGCRTLGLPALLLLLLLRPPATREPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 50174 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 50175 - protein, 203 aa, Homo sapiens
MSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSSGAVLSYSG

SEQ ID NO: 50176 - protein, 231 aa, Homo sapiens
MSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 50177 - protein, 169 aa, Homo sapiens
MAPRRARGCRTLGLPALLLLLLLRPPATREPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 50178 - protein, 202 aa, Homo sapiens
MAPRRARGCRTLGLPALLLLLLLRPPATRGDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 50179 - protein, 252 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 50180 - protein, 187 aa, Homo sapiens
MAPRRARGCRTLGLPALLLLLLLRPPATRGDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 50181 - protein, 234 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 50182 - protein, 219 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 50183 - protein, 866 aa, Homo sapiens
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 50184 - protein, 814 aa, Homo sapiens
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 50185 - protein, 502 aa, Homo sapiens
MSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVILEKWQKKKIAEMGPVQWLATQKKAADKVVFLLSNDVNSVCDGTCGKSEGSPSENSQDLFPLAFNLFCSDLRSQIHLHKYVVVYFREIDTKDDYNALSVCPKYHLMKDATAFCAELLHVKQQVSAGKRSQACHDGCCSL

SEQ ID NO: 50186 - protein, 791 aa, Homo sapiens
MPVPWFLLSLALGRSPVVLSLERLVGPQDATHCSPVSLEPWGDEERLRVQFLAQQSLSLAPVTAATARTALSGLSGADGRREERGRGKSWVCLSLGGSGNTEPQKKGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 50187 - protein, 705 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 50188 - protein, 720 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 50189 - protein, 546 aa, Homo sapiens
MAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 50190 - protein, 707 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 50191 - protein, 70 aa, Homo sapiens
MPVPWFLLSLALGRSPVVLSLERLVGPQDATHCSPGLSCRLWVTYSACLGTSCLLRAPCWRLRTCRQSWC

SEQ ID NO: 50192 - protein, 688 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 50193 - protein, 739 aa, Homo sapiens
MAPWLQLCSVFFTVNACLNGSQLAVAAGGSGRARGADTCGWRGVGPASRNSGLYNITFKYDNCTTYLNPVGKHVIADAQNITISQYACHDQVAVTILWSPGALGIEFLKGFRVILEELKSEGRQCQQLILKDPKQLNSSFKRTGMESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTETTSCLLQNVSPGDYIIELVDDTNTTRKVMHYALKPVHSPWAGPIRAVAITVPLVVISAFATLFTVMCRKKQQENIYSHLDEESSESSTYTAALPRERLRPRPKVFLCYSSKDGQNHMNVVQCFAYFLQDFCGCEVALDLWEDFSLCREGQREWVIQKIHESQFIIVVCSKGMKYFVDKKNYKHKGGGRGSGKGELFLVAVSAIAEKLRQAKQSSSAALSKFIAVYFDYSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVMCKPGPESDFCLKVEAAVLGATGPADSQHESQHGGLDQDGEARPALDGSAALQPLLHTVKAGSPSDMPRDSGIYDSSVPSSELSLPLMEGLSTDQTETSSLTESVSSSSGLGEEEPPALPSKLLSSGSCKADLGCRSYTDELHAVAPL

SEQ ID NO: 50194 - protein, 595 aa, Homo sapiens
MESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTETTSCLLQNVSPGDYIIELVDDTNTTRKVMHYALKPVHSPWAGPIRAVAITVPLVVISAFATLFTVMCRKKQQENIYSHLDEESSESSTYTAALPRERLRPRPKVFLCYSSKDGQNHMNVVQCFAYFLQDFCGCEVALDLWEDFSLCREGQREWVIQKIHESQFIIVVCSKGMKYFVDKKNYKHKGGGRGSGKGELFLVAVSAIAEKLRQAKQSSSAALSKFIAVYFDYSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVMCKPGPESDFCLKVEAAVLGATGPADSQHESQHGGLDQDGEARPALDGSAALQPLLHTVKAGSPSDMPRDSGIYDSSVPSSELSLPLMEGLSTDQTETSSLTESVSSSSGLGEEEPPALPSKLLSSGSCKADLGCRSYTDELHAVAPL

SEQ ID NO: 50195 - protein, 715 aa, Homo sapiens
MPRASASGVPALFVSGEQGVGPASRNSGLYNITFKYDNCTTYLNPVGKHVIADAQNITISQYACHDQVAVTILWSPGALGIEFLKGFRVILEELKSEGRQCQQLILKDPKQLNSSFKRTGMESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTETTSCLLQNVSPGDYIIELVDDTNTTRKVMHYALKPVHSPWAGPIRAVAITVPLVVISAFATLFTVMCRKKQQENIYSHLDEESSESSTYTAALPRERLRPRPKVFLCYSSKDGQNHMNVVQCFAYFLQDFCGCEVALDLWEDFSLCREGQREWVIQKIHESQFIIVVCSKGMKYFVDKKNYKHKGGGRGSGKGELFLVAVSAIAEKLRQAKQSSSAALSKFIAVYFDYSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVMCKPGPESDFCLKVEAAVLGATGPADSQHESQHGGLDQDGEARPALDGSAALQPLLHTVKAGSPSDMPRDSGIYDSSVPSSELSLPLMEGLSTDQTETSSLTESVSSSSGLGEEEPPALPSKLLSSGSCKADLGCRSYTDELHAVAPL

SEQ ID NO: 50196 - protein, 595 aa, Homo sapiens; identical to SEQ ID NO: 50194

SEQ ID NO: 50197 - protein, 73 aa, Homo sapiens
MESQPFLNMKFETDYFVKVVPFPSIKNESNYHPFFFRTRACDLLLQPDNLACKPFWKPRNLNISQHGSDMQVS

SEQ ID NO: 50198 - protein, 541 aa, Homo sapiens
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 50199 - protein, 170 aa, Homo sapiens
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKIGPPICRKTSSGLH

SEQ ID NO: 50200 - protein, 541 aa, Homo sapiens; identical to SEQ ID NO: 50198

SEQ ID NO: 50201 - protein, 541 aa, Homo sapiens; identical to SEQ ID NO: 50198

SEQ ID NO: 50202 - protein, 599 aa, Homo sapiens
MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 50203 - protein, 457 aa, Homo sapiens
MILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 50204 - protein, 44 aa, Homo sapiens
MLCLGWIFLWLVAGERIKGFNISGCSTKKLLWTYSTRSEEEFVL

SEQ ID NO: 50205 - protein, 177 aa, Homo sapiens
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 50206 - protein, 215 aa, Homo sapiens
MCTEGAFPHRSACSLPLTHVHTHIHVCVPVLWGSVPRGMKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 50207 - protein, 263 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEEKPQASPEGRPESETSCLVTTTDFQIQTEMAATMETSIFTTEYQVAVAGCVFLLISVLLLSGLTWQRRQRKSRRTI

SEQ ID NO: 50208 - protein, 200 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGEEKPQASPEGRPESETSCLVTTTDFQIQTEMAATMETSIFTTEYQVAVAGCVFLLISVLLLSGLTWQRRQRKSRRTI

SEQ ID NO: 50209 - protein, 272 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 50210 - protein, 162 aa, Homo sapiens
MVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPDFQIQTEMAATMETSIFTTEYQVAVAGCVFLLISVLLLSGLTWQRRQRKSRRTI

SEQ ID NO: 50211 - protein, 109 aa, Homo sapiens
  MOD_RES (1)..(1): Any amino acid
XIPHATFKAMAYKEGTMLNCECKRGFRRIKSGSLYMLCTGNSSHSSWDNQCQCTSSATRNTTKQVTPQPEEQKERKTTEMQSPMQPVDQASLPDFQIQTEMAATMETSI

SEQ ID NO: 50212 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 50213 - protein, 146 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETH

SEQ ID NO: 50214 - protein, 88 aa, Homo sapiens
MAAPALSWRLPLLILLLPLATSWASAAVNGTSQFTCFYNSRANISCVWSQDGALQDTSCQVHAWPDRRRWNQTCELLPVSQASWACNL

SEQ ID NO: 50215 - protein, 188 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQ

SEQ ID NO: 50216 - protein, 98 aa, Homo sapiens
MEPPNPLGEQYFKRTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 50217 - protein, 157 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLGTISGL

SEQ ID NO: 50218 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 50219 - protein, 179 aa, Homo sapiens
MGMKTPQLEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 50220 - protein, 553 aa, Homo sapiens
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 50221 - protein, 209 aa, Homo sapiens
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTVSLKWNGAYIHVPLCS

SEQ ID NO: 50222 - protein, 442 aa, Homo sapiens
MSYNGLHQRVFKELKLLTLCSISSQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 50223 - protein, 504 aa, Homo sapiens
MKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 50224 - protein, 538 aa, Homo sapiens
MPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLLVIVFIPAFWSLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 50225 - protein, 538 aa, Homo sapiens; identical to SEQ ID NO: 50224

SEQ ID NO: 50226 - protein, 538 aa, Homo sapiens; identical to SEQ ID NO: 50224

SEQ ID NO: 50227 - protein, 263 aa, Homo sapiens
MMPKHCFLGFLISFFLTGVAGTQSTHESLKPQRVQFQSRNFHNILQWQPGRALTGNSSVYFVQYKIMFSCSMKSSHQKPSGCWQHISCNFPGCRTLAKYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 50228 - protein, 130 aa, Homo sapiens
MMPKHCFLGFLISFFLTGVAGTQSTHESLKPQRVQFQSRNFHNILQWQPGRALTGNSSVYFVQYKIYGQRQWKNKEDCWGTQELSCDLTSETSDIQEPYYGRVRAASAGSYSEWSMTPRFTPWWERAKGL

SEQ ID NO: 50229 - protein, 231 aa, Homo sapiens
MMPKHCFLGFLISFFLTGVAGTQSTHESLKPQRVQFQSRNFHNILQWQPGRALTGNSSVYFVQYKIYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 50230 - protein, 520 aa, Homo sapiens
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALDFSGHTHPVATFQPSRPESVNDLFLCPQKELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 50231 - protein, 244 aa, Homo sapiens
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPGLFWTHTPCGNLSAQQTRVRE

SEQ ID NO: 50232 - protein, 211 aa, Homo sapiens
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKVGSSFPAPRLGPLLHPFLLRFFSPSQPAPAPLLQEVFPVHS

SEQ ID NO: 50233 - protein, 185 aa, Homo sapiens
MMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALV

SEQ ID NO: 50234 - protein, 491 aa, Homo sapiens
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 50235 - protein, 152 aa, Homo sapiens
MSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 50236 - protein, 378 aa, Homo sapiens
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 50237 - protein, 300 aa, Homo sapiens
MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 50238 - protein, 164 aa, Homo sapiens
MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQI

SEQ ID NO: 50239 - protein, 440 aa, Homo sapiens
MTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFCKHAHSEVEKNPKPQIDAMDRPVVGMAPPSHCDLQPGMNHLASLNLSENGAKSTHLLGFWGLNESEVTVPERRVLRKWKELL

SEQ ID NO: 50240 - protein, 662 aa, Homo sapiens
MKLSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGTRILSSCPTSI

SEQ ID NO: 50241 - protein, 681 aa, Homo sapiens
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGTRILSSCPTSI

SEQ ID NO: 50242 - protein, 662 aa, Homo sapiens; identical to SEQ ID NO: 50240

SEQ ID NO: 50243 - protein, 582 aa, Homo sapiens
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFCKHAHSEVEKNPKPQIDAMDRPVVGMAPPSHCDLQPGMNHLASLNLSENGAKSTHLLGFWGLNESEVTVPERRVLRKWKELL

SEQ ID NO: 50244 - protein, 764 aa, Homo sapiens
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGYVTCPFRPDCPLGKSFEELPVSPEIPPRKSQYLRSRMPEGTRPEAKEQLLFSGQSLVPDHLCEEGAPNPYLKNSVTAREFLVSEKLPEHTKGEV

SEQ ID NO: 50245 - protein, 622 aa, Homo sapiens
MTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGYVTCPFRPDCPLGKSFEELPVSPEIPPRKSQYLRSRMPEGTRPEAKEQLLFSGQSLVPDHLCEEGAPNPYLKNSVTAREFLVSEKLPEHTKGEV

SEQ ID NO: 50246 - protein, 155 aa, Homo sapiens
MVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 50247 - protein, 155 aa, Homo sapiens; identical to SEQ ID NO: 50246

SEQ ID NO: 50248 - protein, 117 aa, Homo sapiens
MVLSGALCFRMKDSALKVLYLHNNQLLAGGLHAGKVIKGEEISVVPNRWLDASLSPVILGVQGGSQCLSCGVGQEPTLTLEPVNIMELYLGAKESKSFTFYRRDMGLTSSFESAAYP

SEQ ID NO: 50249 - protein, 825 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 50250 - protein, 810 aa, Homo sapiens
MQKDARREGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 50251 - protein, 227 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNFSVC

SEQ ID NO: 50252 - protein, 825 aa, Homo sapiens; identical to SEQ ID NO: 50249

SEQ ID NO: 50253 - protein, 227 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSNIC

SEQ ID NO: 50254 - protein, 825 aa, Homo sapiens; identical to SEQ ID NO: 50249

SEQ ID NO: 50255 - protein, 420 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 50256 - protein, 335 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGFSR

SEQ ID NO: 50257 - protein, 150 aa, Homo sapiens
MTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEVLCIFIYILDSADNFLQKKKAGSSETEIEVICYIEKPGVETLEDSVF

SEQ ID NO: 50258 - protein, 335 aa, Homo sapiens; identical to SEQ ID NO: 50256

SEQ ID NO: 50259 - protein, 325 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 50260 - protein, 109 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLL

SEQ ID NO: 50261 - protein, 333 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGK

SEQ ID NO: 50262 - protein, 378 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKIKLGPVRRKLKSSVI

SEQ ID NO: 50263 - protein, 196 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIAC

SEQ ID NO: 50264 - protein, 211 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 50265 - protein, 420 aa, Homo sapiens; identical to SEQ ID NO: 50255

SEQ ID NO: 50266 - protein, 333 aa, Homo sapiens; identical to SEQ ID NO: 50261

SEQ ID NO: 50267 - protein, 365 aa, Homo sapiens [sequence omitted]

SEQ ID NO: 50268 - protein, 468 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 50269 - protein, 918 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 50270 - protein, 329 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDNIASF

SEQ ID NO: 50271 - protein, 857 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 50272 - protein, 918 aa, Homo sapiens; identical to SEQ ID NO: 50269

SEQ ID NO: 50273 - protein, 329 aa, Homo sapiens; identical to SEQ ID NO: 50270

SEQ ID NO: 50274 - protein, 329 aa, Homo sapiens; identical to SEQ ID NO: 50270

SEQ ID NO: 50275 - protein, 329 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDTIFSF

SEQ ID NO: 50276 - protein, 459 aa, Homo sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 50277 - protein, 262 aa, Homo sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGLSLSYGPVSPIIRRLWNIFVRNQEKI

SEQ ID NO: 50278 - protein, 261 aa, Homo sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGLSLSYGPVSPIIRRLWNIFVRNQEK

SEQ ID NO: 50279 - protein, 59 aa, Homo sapiens
MTILGTTFGMVFSLLQVVSGESGYAQNGDLEDAELDDYSFSCYSQLEVNGSQHSLTCAF

SEQ ID NO: 50280 - protein, 52 aa, Homo sapiens
MTILGTTFGMVFSLLQVVSGESGYAQNGDLEDAELDDYSFSCYSQLEVNGSQ

SEQ ID NO: 50281 - protein, 521 aa, Homo sapiens
MGLGRCIWEGWTLESEALRRDMGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHGAGVLLSQDCAGTPQGALEPCVQEATALLTCGPARPWKSVALEEEQEGPGTRLPGNLSSEDVLPAGCTEWRVQTLAYLPQEDWAPTSLTRPAPPDSEGSRSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 50282 - protein, 342 aa, Homo sapiens
MPQTCDGTGQMHLGSNCCKNGQTLLQRTCHGVSCCGWWFQAARSILGKGPSAQSLAGWTLESEALRRDMGTWLLACICICTCVCLGVSVTGEGQGPRSRTFTCLTNNILRIDCHWSAPELGQGSSPWLLFTRLLAAHISASCGAVSAPSCCHLRQCSCHLTISPSLSTTACLGGSRSAWWTRSTCPGDTSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRLGWGPTGPVCC

SEQ ID NO: 50283 - protein, 500 aa, Homo sapiens
MGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHGAGVLLSQDCAGTPQGALEPCVQEATALLTCGPARPWKSVALEEEQEGPGTRLPGNLSSEDVLPAGCTEWRVQTLAYLPQEDWAPTSLTRPAPPDSEGSRSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 50284 - protein, 329 aa, Homo sapiens
MGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQVCAETTEGHGGQGLPRALACPRCWLS

SEQ ID NO: 50285 - protein, 332 aa, Homo sapiens
MHLGSNCCKNGQTLLQRTCHGVSCCGWWFQAARSILGKGPSAQSLAGWTLESEALRRDMGTWLLACICICTCVCLGVSVTGEGQGPRSRTFTCLTNNILRIDCHWSAPELGQGSSPWLLFTRLLAAHISASCGAVSAPSCCHLRQCSCHLTISPSLSTTACLGGSRSAWWTRSTCPGDTSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRLGWGPTGPVCC

SEQ ID NO: 50286 - protein, 625 aa, Homo sapiens
MACYIYQLPSWVLDDLCRNMDALSEWDWMEFASYVITDLTQLRKIKSMERVQGVSITRELLWWWGMRQATVQQLVDLLCRLELYRAAQIILNWKPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQAELQICLRCCHPNVLPVLGFCAARQFHSFIYPYMANGSLQDRLQGQGGSDPLPWPQRVSICSGLLCAVEYLHGLEIIHSNVKSSNVLLDQNLTPKLAHPMAHLCPVNKRSKYTMMKTHLLRTSAAYLPEDFIRVGQLTKRVDIFSCGIVLAEVLTGIPAMDNNRSPVYLKDLLLSDIPSSTASLCSRKTGVENVMAKEICQKYLEKGAGRLPEDCAEALATAACLCLRRRNTSLQEVCGSVAAVEERLRGRETLLPWSGLSEGTGSSSNTPEETDDVDNSSLDASSSMSVAPWAGAATPLLPTENGEGRLRVIVGREADSSSEACVGLEPPQDVTETSWQIEINEAKRKLMENILLYKEEKVDSIELFGP

SEQ ID NO: 50287 - protein, 596 aa, Homo sapiens
MAGNCGARGALSAHTLLFDLPPALLGELCAVLDSCDGALGWRGLAERLSSSWLDVRHIEKYVDQGKSGTRELLWSWAQKNKTIGDLLQVLQEMGHRRAIHLITNYGAVLSPSEKSYQEGGFPNILFKETANVTVDNVLIPEHNEKGILLKSSISFQNIIEGTRNFHKDFLIGEGEIFEVYRVEIQNLTYAVKLFKQEKKMQCKKHWKRFLSELEVLLLFHHPNILELAAYFTETEKFCLIYPYMRNGTLFDRLQCVGDTAPLPWHIRIGILIGISKAIHYLHNVQPCSVICGSISSANILLDDQFQPKLTDFAMAHFRSHLEHQSCTINMTSSSSKHLWYMPEEYIRQGKLSIKTDVYSFGIVIMEVLTGCRVVLDDPKHIQLRDLLRELMEKRGLDSCLSFLDKKVPPCPRNFSAKLFCLAGRCAATRAKLRPSMDEVLNTLESTQASLYFAEDPPTSLKSFRCPSPLFLENVPSIPVEDDESQNNNLLPSDEGLRIDRMTQKTPFECSQSEVMFLSLDKKPESKRNEEACNMPSSSCEESWFPKYIVPSQDLRPYKVNIDPSSEAPGHSCRSRPVESSCSSKFSWDEYEQYKKE

SEQ ID NO: 50288 - protein, 535 aa, Homo sapiens
MAGNCGARGALSAHTLLFDLPPALLGELCAVLDSCDGALGWRGLGAVLSPSEKSYQEGGFPNILFKETANVTVDNVLIPEHNEKGILLKSSISFQNIIEGTRNFHKDFLIGEGEIFEVYRVEIQNLTYAVKLFKQEKKMQCKKHWKRFLSELEVLLLFHHPNILELAAYFTETEKFCLIYPYMRNGTLFDRLQCVGDTAPLPWHIRIGILIGISKAIHYLHNVQPCSVICGSISSANILLDDQFQPKLTDFAMAHFRSHLEHQSCTINMTSSSSKHLWYMPEEYIRQGKLSIKTDVYSFGIVIMEVLTGCRVVLDDPKHIQLRDLLRELMEKRGLDSCLSFLDKKVPPCPRNFSAKLFCLAGRCAATRAKLRPSMDEVLNTLESTQASLYFAEDPPTSLKSFRCPSPLFLENVPSIPVEDDESQNNNLLPSDEGLRIDRMTQKTPFECSQSEVMFLSLDKKPESKRNEEACNMPSSSCEESWFPKYIVPSQDLRPYKVNIDPSSEAPGHSCRSRPVESSCSSKFSWDEYEQYKKE

SEQ ID NO: 50289 - protein, 218 aa, Homo sapiens
MNKPITPSTYVRCLNVGLIRKLSDFIDPQEGWKKLAVAIKKPSGDDRYNQFHIRRFEALLQTGKSPTSELLFDWGTTNCTVGDLVDLLIQNEFFAPASLLLPDAVPKTANTLPSKEAITVQQKQMPFCDKDRTLMTPVQNLEQSYMPPDSSSPENKSLEVSDTRFHSFSFYELKNVTNNFDERPISVGGNKMGEGGFGVVYKGYVNNNCGSEEACSNG

SEQ ID NO: 50290 - protein, 336 aa, Homo sapiens
MPFCDKDRTLMTPVQNLEQSYMPPDSSSPENKSLEVSDTRFHSFSFYELKNVTNNFDERPISVGGNKMGEGGFGVVYKGYVNNTTVAVKKLAAMVDITTEELKQQFDQEIKVMAKCQHENLVELLGFSSDGDDLCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKEEIEDEEKTIEDYIDKKMNDADSTSVEAMYSVASQCLHEKKNKRPDIKKVQQLLQEMTAS

SEQ ID NO: 50291 - protein, 336 aa, Homo sapiens; identical to SEQ ID NO: 50290

SEQ ID NO: 50292 - protein, 460 aa, Homo sapiens
MNKPITPSTYVRCLNVGLIRKLSDFIDPQEGWKKLAVAIKKPSGDDRYNQFHIRRFEALLQTGKSPTSELLFDWGTTNCTVGDLVDLLIQNEFFAPASLLLPDAVPKTANTLPSKEAITVQQKQMPFCDKDRTLMTPVQNLEQSYMPPDSSSPENKSLEVSDTRFHSFSFYELKNVTNNFDERPISVGGNKMGEGGFGVVYKGYVNNTTVAVKKLAAMVDITTEELKQQFDQEIKVMAKCQHENLVELLGFSSDGDDLCLVYVYMPNGSLLDRLSCLDGTPPLSWHMRCKIAQGAANGINFLHENHHIHRDIKSANILLDEAFTAKISDFGLARASEKFAQTVMTSRIVGTTAYMAPEALRGEITPKSDIYSFGVVLLEIITGLPAVDEHREPQLLLDIKEEIEDEEKTIEDYIDKKMNDADSTSVEAMYSVASQCLHEKKNKRPDIKKVQQLLQEMTAS

SEQ ID NO: 50293 - protein, 89 aa, Homo sapiens
MNKPITPSTYVRCLNVGLIRKLSDFIDPQEGWKKLAVAIKKPSGDDRYNQFHIRRFEALLQTGKSPTSELLFDWGTTNCTVGDLVDLLI

SEQ ID NO: 50294 - protein, 460 aa, Homo sapiens; identical to SEQ ID NO: 50292

SEQ ID NO: 50295 - protein, 797 aa, Homo sapiens
MYLETRRAIFVFWIFLQVQGTKDISINIYHSETKDIDNPPRNETTESTEKMYKMSTMRRIFDLAKHRTKRSAFFPTGVKVCPQESMKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 50296 - protein, 158 aa, Homo sapiens
ERPNGTSAQPAQVKPEFYRQAELKPCPWTGSNQRRCITFCPTPDQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 50297 - protein, 147 aa, Homo sapiens
MYLETRRAIFVFWIFLQVQGTKVCQEAVWEAYRIFLDRIPDTGEYQDWVSICQQETFCLFDIGKNFSNSQEHLDLLQQRIKQRSFPDRKDEISAEKTLGEPGETIVISTEKNKGKTKPFNILQFGNNHHEHLLPIFCLLSSIIYTYY

SEQ ID NO: 50298 - protein, 1241 aa, Homo sapiens
MIMFPLFGKISLGILIFVLIEGDFPSLTAQTYLSIEEIQEPKSAVSFLLPEESTDLSLATKKKQPLDRRETERQWLIRRRRSILFPNGVKICPDESVAEAVANHVKYFKVRVCQEAVWEAFRTFWDRLPGREEYHYWMNLCEDGVTSIFEMGTNFSESVEHRSLIMKKLTYAKETVSSSELSSPVPVGDTSTLGDTTLSVPHPEVDAYEGASESSLERPEESISNEIENVIEEATKPAGEQIAEFSIHLLGKQYREELQDSSSFHHQHLEEEFISEVENAFTGLPGYKEIRVLEFRSPKENDSGVDVYYAVTFNGEAISNTTWDLISLHSNKVENHGLVELDDKPTVVYTISNFRDYIAETLQQNFLLGNSSLNPDPDSLQLINVRGVLRHQTEDLVWNTQSSSLQATPSSILDNTFQAAWPSADESITSSIPPLDFSSGPPSATGRELWSESPLGDLVSTHKLAFPSKMGLSSSPEVLEVSSLTLHSVTPAVLQTGLPVASEERTSGSHLVEDGLANVEESEDFLSIDSLPSSSFTQPVPKETIPSMEDSDVSLTSSPYLTSSIPFGLDSLTSKVKDQLKVSPFLPDASMEKELIFDGGLGSGSGQKVDLITWPWSETSSEKSAEPLSKPWLEDDDSLLPAEIEDKKLVLVDKMDSTDQISKHSKYEHDDRSTHFPEEEPLSGPAVPIFADTAAESASLTLPKHISEVPGVDDYSVTKAPLILTSVAISASTDKSDQADAILREDMEQITESSNYEWFDSEVSMVKPDMQTLWTILPESERVWTRTSSLEKLSRDILASTPQSADRLWLSVTQSTKLPPTTISTLLEDEVIMGVQDISLELDRIGTDYYQPEQVQEQNGKVGSYVEMSTSVHSTEMVSVAWPTEGGDDLSYTQTSGALVVFFSLRVTNMMFSEDLFNKNSLEYKALEQRFLELLVPYLQSNLTGFQNLEILNFRNGSIVVNSRMKFANSVPPNVNNAVYMILEDFCTTAYNTMNLAIDKYSLDVESGDEANPCKFQACNEFSECLVNPWSGEAKCRCFPGYLSVEERPCQSLCDLQPDFCLNDGKCDIMPGHGAICRCRVGENWWYRGKHCEEFVSEPVIIGITIASVVGLLVIFSAIIYFFIRTLQAHHDRSERESPFSGSSRQPDSLSSIENAVKYNPVYESHRAGCEKYEGPYPQHPFYSSASGDVIGGLSREEIRQMYESSELSREEIQERMRVLELYANDPEFAAFVREQQVEEV

SEQ ID NO: 50299 - protein, 66 aa, Homo sapiens
GYLSVEERPCQSLCDLQPDFCLNDGKCDIMPGHGAICSGSSRQPDSLSSIENAVKYNPVYESHRAG

SEQ ID NO: 50300 - protein, 914 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQHGFWFFRESC

SEQ ID NO: 50301 - protein, 317 aa, Homo sapiens
  MOD_RES (1)..(1): Any amino acid
XPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQD

SEQ ID NO: 50302 - protein, 1721 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVIGCWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQWCSDLHLLDMLTPTERKRQGYIHELIVTEENYVNDLQLVTEIFQKPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNILENTPENHPDHSHLKHALEKAEELCSQVNEGVREKENSDRLEWIQAHVQCEGLSEQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQDTLNPKWNSNCQFFIRDLEQEVLCITVFERDQFSPDDFLGRTEIRVADIKKDQGSKGPVTKCLLLHEVPTGEIVVRLDLQLFDEP

SEQ ID NO: 50303 - protein, 1650 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVIGCWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQWCSDLHLLDMLTPTERKRQGYIHELIVTEENYVNDLQLVTEIFQKPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNILENTPENHPDHSHLKHALEKAEELCSQVNEGVREKENSDRLEWIQAHVQCEGLSEQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQDTLNPKWNSNCQFFIRDLEQEVLCITVFERDQFSPDDFLGRTEIRVADIKKDQGSKGPVTKCLLLHEVPTGEIVVRLDLQLFDEP

SEQ ID NO: 50304 - protein, 1078 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPGPSCNVK

SEQ ID NO: 50305 - protein, 1220 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVKGEWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 50306 - protein, 1721 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVKGEWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQWCSDLHLLDMLTPTERKRQGYIHELIVTEENYVNDLQLVTEIFQKPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNILENTPENHPDHSHLKHALEKAEELCSQVNEGVREKENSDRLEWIQAHVQCEGLSEQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQDTLNPKWNSNCQFFIRDLEQEVLCITVFERDQFSPDDFLGRTEIRVADIKKDQGSKGPVTKCLLLHEVPTGEIVVRLDLQLFDEP

SEQ ID NO: 50307 - protein, 1015 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEGLWNCWENREFRKKT

SEQ ID NO: 50308 - protein, 1020 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQPDFLLHPSMRLGHMQPRIVLLFPDPLQCSTSRLLPMLRPRPGVPFLRSPSCQSPSHPSRPISDAAPSVKFTLMPPGRIHPCFLFIPAVNSRNSFLVYFILPGGTLGCFYLCLPHYL

SEQ ID NO: 50309 - protein, 1144 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 50310 - protein, 1215 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 50311 - protein, 1178 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 50312 - protein, 1149 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVKGEWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 50313 - protein, 1716 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQWCSDLHLLDMLTPTERKRQGYIHELIVTEENYVNDLQLVTEIFQKPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNILENTPENHPDHSHLKHALEKAEELCSQVNEGVREKENSDRLEWIQAHVQCEGLSEQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQDTLNPKWNSNCQFFIRDLEQEVLCITVFERDQFSPDDFLGRTEIRVADIKKDQGSKGPVTKCLLLHEVPTGEIVVRLDLQLFDEP

SEQ ID NO: 50314 - protein, 1660 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQWCSDLHLLDMLTPTERKRQGYIHELIVTEENYVNDLQLVTEIFQKPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQDTLNPKWNSNCQFFIRDLEQEVLCITVFERDQFSPDDFLGRTEIRVADIKKDQGSKGPVTKCLLLHEVPTGEIVVRLDLQLFDEP

SEQ ID NO: 50315 - protein, 115 aa, Homo sapiens
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAF

SEQ ID NO: 50316 - protein, 78 aa, Homo sapiens
MAQFPTPFGGSLDIWAITVEERAKHDQQFHSLKPISGFITGDQARNFFFQSGLPQPVLAQIWALADMNNDGRMDQVEF

SEQ ID NO: 50317 - protein, 1697 aa, Homo sapiens
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKCGNMDDSVLQCLLSLLSCLNNLFLLLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 50318 - protein, 1670 aa, Homo sapiens
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 50319 - protein, 1670 aa, Homo sapiens; identical to SEQ ID NO: 50318

SEQ ID NO: 50320 - protein, 611 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSRSWSSGSSAHSPATHRAPLSSPVPNSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLE

SEQ ID NO: 50321 - protein, 1249 aa, Homo sapiens
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKCGNMDDSVLQCLLSLLSCLNNLFLLLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVRRLLLASSRGICCLS

SEQ ID NO: 50322 - protein, 632 aa, Homo sapiens
MNRYTTIRQLGDGTYGSVLLGRSIESGELIAIKKMKRKFYSWEECMNLREVKSLKKLNHANVVKLKEVIRENDHLYFIFEYMKENLYQLIKERNKLFPESAIRNIMYQILQGLAFIHKHGFFHRDLKPENLLCMGPELVKIADFGLAREIRSKPPYTDYVSTRWYRAPEVLLRSTNYSSPIDVWAVGCIMAEVYTLRPLFPGASEIDTIFKICQVLGTPKKTDWPEGYQLSSAMNFRWPQCVPNNLKTLIPNASSEAVQLLRDMLQWDPKKRPTASQALRYPYFQVGHPLGSTTQNLQDSEKPQKGILEKAGPPPYIKPVPPAQPPAKPHTRISSRQHQASQPPLHLTYPYKAEVSRTDHPSHLQEDKPSPLLFPSLHNKHPQSKITAGLEHKNGEIKPKSRRRWGLISRSTKDSDDWADLDDLDFSPSLSRIDLKNKKRQSDDTLCRFESVLDLKPSEPVGTGNSAPTQTSYQRRDTPTLRSAAKQHYLKHSRYLPGISIRNGILSNPGKEFIPPNPWSSSGLSGKSSGTMSVISKVNSVGSSSTSSSGLTGNYVPSFLKKEIGSAMQRVHLAPIPDPSPGYSSLKAMRPHPGRPFFHTQPRSTPGLIPRPPAAQPVHGRTDWASKYASRR

SEQ ID NO: 50323 - protein, 632 aa, Homo sapiens; identical to SEQ ID NO: 50322

SEQ ID NO: 50324 - protein, 245 aa, Homo sapiens
MCAEVGPALCRGMERNSLGCCEAPKKLSLSFSIEAILKRPARRSDMDRPEGPGEEGPGEAAASGSGLEKPPKDQPQEGRKSKRRVRTTFTTEQLHELEKIFHFTHYPDVHIRSQLAARINLPEARVQIWFQNQRAKWRKQEKIGNLGAPQQLSEASVALPTNLDVAGPTWTSTALRRLAPPTSCCPSAQDQLASAWFPAWITLLPAHPWETQPVPGLPIHQTCIPVLCILPPPHPKWGSICATST

SEQ ID NO: 50325 - protein, 245 aa, Homo sapiens; identical to SEQ ID NO: 50324

SEQ ID NO: 50326 - protein, 582 aa, Homo sapiens
MANEDCPKAADSPFSSDKHAQLILAQINKMRNGQHFCDVQLQVGQESFKAHRLVLAASSPYFAALFTGGMKESSKDVVPILGIEAGIFQILLDFIYTGIVNIGVNNVQELIIAADMLQLTEVVHLCCEFLKGQIDPLNCIGIFQFSEQIACHDLLEFSENYIHVHFLEVHSGEEFLALTKDQLIKILRSEELSIEDEYQVFLAAMQWILKDLGKRRKHVVEVLDPIRFPLLPPQRLLKYIEGVSDFNLRVALQTLLKEYCEVCKSPKENKFCSFLQTSKVRPRKKARKYLYAVGGYTRLQGGRWSDSRALSCVERFDTFSQYWTTVSSLHQARSGLGVTVLGGMVYAIGGEKDSMIFDCTECYDPVTKQWTTVASMNHPRCGLGVCVCYGAIYALGGWVGAEIGNTIERFDPDENKWEVVGNMAVSRYYFGCCEMQGLIYVIGGISNEGIELRSFEVYDPLSKRWSPLPPMGTRRAYLGVAALNDCIYSVGGWNETQDALHTVEKYSFEEEKWVEVASMKVPRAGMCVVAVNGLLYVSGGRSSSHDFLAPDTHRYEVFRLKWENMCILFNDHKTLTKGIFNL

SEQ ID NO: 50327 - protein, 584 aa, Homo sapiens
MANEDCPKAADSPFSSDKHAQLILAQINKMRNGQHFCDVQLQVGQESFKAHRLVLAASSPYFAALFTGGMKESSKDVVPILGIEAGIFQILLDFIYTGIVNIGVNNVQELIIAADMLQLTEVVHLCCEFLKGQIDPLNCIGIFQFSEQIACHDLLEFSENYIHVHFLEVHSGEEFLALTKDQLIKILRSEELSIEDEYQVFLAAMQWILKDLGKRRKHVVEVLDPIRFPLLPPQRLLKYIEGVSDFNLRVALQTLLKEYCEVCKSPKENKFCSFLQTSKVRPRKKARKYLYAVGGYTRLQGGRWSDSRALSCVERFDTFSQYWTTVSSLHQARSGLGVTVLGGMVYAIGGEKDSMIFDCTECYDPVTKQWTTVASMNHPRCGLGVCVCYGAIYALGGWVGAEIGNTIERFDPDENKWEVVGNMAVSRYYFGCCEMQGLIYVIGGISNEGIELRSFEVYDPLSKRWSPLPPMGTRRAYLGVAALNDCIYSVGGWNETQDALHTVEKYSFEEEKWVEVASMKVPRAGMCVVAVNGLLYVSGGRSSSHDFLAPGTLDSVEVYNPHSDTWTEIGNMITSRCEGGVAVL

SEQ ID NO: 50328 - protein, 1292 aa, Homo sapiens
MRAVLTWRDKAEHCINDIAFKPDGTQLILAAGSRLLVYDTSDGTLLQPLKGHKDTVYCVAYAKDGKRFASGSADKSVIIWTSKLEGILKYTSWSVMSSLHLHLPFLGLHKTVRVTATDKAPKGQGGRIDCLRPSVQNQPGQKHNDAIQCVSYNPITHQLASCSSSDFGLWSPEQKSVSKHKSSSKIICCSWTNDGQYLALGMFNGIISIRNKNGEEKVKIERPGGSLSPIWSICWNPSSRWESFWMNRENEDAEDVIVNRYIQEIPSTLKSAVYSSQGSEAEEEEPEEEDDSPRDDNLEERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 50329 - protein, 1182 aa, Homo sapiens
MRAVLTWRDKAEHCINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 50330 - protein, 1241 aa, Homo sapiens
MRAVLTWRDKAEHCINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCSWTNDGQYLALGMFNGIISIRNKNGEEKVKIERPGGSLSPIWSICWNPSSRWESFWMNRENEDAEDVIVNRYIQEIPSTLKSAVYSSQGSEAEEEEPEEEDDSPRDDNLEERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 50331 - protein, 1131 aa, Homo sapiens
MRAVLTWRDKAEHCINDIAFKPDGTQLILAAGSRLLVYDTSDGTLLQPLKGHKDTVYCVAYAKDGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQADPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 50332 - protein, 1091 aa, Homo sapiens
MFNGIISIRNKNGEEKVKIERPGGSLSPIWSICWNPSSRWESFWMNRENEDAEDVIVNRYIQEIPSTLKSAVYSSQGSEAEEEEPEEEDDSPRDDNLEERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 50333 - protein, 1032 aa, Homo sapiens
MFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 50334 - protein, 1083 aa, Homo sapiens
MRAVLTWRDKAEHCINDIAFKPDGTQLILAAGSRLLVYDTSDGTLLQPLKGHKDTVYCVAYAKDGLWSPEQKSVSKHKSSSKIICCREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQADPAQKDTMLGKFYHFQRLAELYHGYHAIHRHTEDPFSVHRPETLFNISRFLLHSLPKDTPSGISKVRKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 50335 - protein, 961 aa, Homo sapiens
MRAVLTWRDKAEHCINDIAFKPDGTQLILAAGSRLLVYDTSDGTLLQPLKGHKDTVYCVAYAKDGKRFASGSADKSVIIWTSKLEGILKYTHNDAIQCVSYNPITHQLASCSSSDFGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKAFIRVQDLRYLELISSIEERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQDPAQKDTMLGKFYHFQRLAELYHGYHAIHRHTEDPFSVHRPETLFNISRFLLHSLPKDTPSGISKVCENTLHLGQAEQGPRCLQAGPARL

SEQ ID NO: 50336 - protein, 1118 aa, Homo sapiens
MRAVLTWRDKAEHCINDIAFKPDGTQLILAAGSRLLVYDTSDGTLLQPLKGHKDTVYCVAYAKDVLCIEGLWSPEQKSVSKHKSSSKIICCSWTNDGQYLALGMFNGIISIRNKNGEEKVKIERPGGSLSPIWSICWNPSREERNDILAVADWGQKVSFYQLSGKQIGKDRALNFDPCCISYFTKGEYILLGGSDKQVSLFTKDGVRLGTVGEQNSWVWTCQAKPDSNYVVVGCQDGTISFYQLIFSTVHGLYKDRYAYRDSMTDVIVQHLITEQKVRIKCKELVKKIAIYRNRLAIQLPEKILIYELYSEDLSDMHYRVKEKIIKKFECNLLVVCANHIILCQEKRLQCLSFSGVKEREWQMESLIRYIKVIGGPPGREGLLVGLKNGQILKIFVDNLFAIVLLKQATAVRCLDMSASRKKLAVVDENDTCLVYDIDTKELLFQEPNANSVAWNTQCEDMLCFSGGGYLNIKASTFPVHRQKLQGFVVGYNGSKIFCLHVFSISAVEVPQSAPMYQYLDRKLFKEAYQIACLGVTDTDWRELAMEALEGLDFETAKKERKKRGETNNDLFLADVFSYQGKFHEAAKLYKRSGHENLALEMYTDLCMFEYAKDFLGSGDPKETKMLITKQADWARNIKEPKAAVEMYISAGEHVKAIEICGDHGWVDMLIDIARKLDKAEREPLLLCATYLKKLDSPGYAAETYLKMGDLKSLVQLHVETQRWDEAFALGEKHPEFKDDIYMPYAQWLAENDRFEEAQKAFHKAGRQREAVQVLEQLTNNAVAESRFNDAAYYYWMLSMQCLDIAQADPAQKDTMLGKFYHFQRLAELYHGYHAIHRHTEDPFSVHRPETLFNISRFLLHSLPKDTPSGISKVKILFTLAKQSKALGAYRLARHAYDKLRGLYIPARFQKSIELGTLTIRAKPFHDSEELVPLCYRCSTNNPLLNNLGNVCINCRQPFIFSASSYDVLHLVEFYLEEGITDEEAISLIDLEVLRPKRDDRQLEIANNSSQILRLVETKDSIGDEDPFTAKLSFEQGGSEFVPVVVSRLVLRSMSRRDVLIKRWPPPLRWQYFRSLLPDASITMCPSCFQMFHSEDYELLVLQHGCCPYCRRCKDDPGP

SEQ ID NO: 50337 - protein, 1749 aa, Homo sapiens
MHLKHLRTLLSPQDGAAKVTCMAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRLHLYDIESCSKTMILNFCSYMQWVPGSDVLVAQNRNSLCVWYNIEAPERVTMFTIRGDVIGLERGGGKTEVMVMEGVTTVAYTLDEGLIEFGTAIDDGNYIRATAFLETLEMTPETEAMWKTLSKLALEARQLHIAERCFSALGQVAKARFLHETNEIADQVSREYGGEGTDFYQVRARLAMLEKNYKLAEMIFLEQNAVEEAMGMYQELHRWDECIAVAEAKGHPALEKLRRSYYQWLMDTQQEERAGELQESQGDGLAAISLYLKAGLPAKAARLVLTREELLANTELVEHITAALIKGELYERAGDLFEKIHNPQKALECYRKGNAFMKAVELARLAFPVEVVKLEEAWGDHLVQQKQLDAAINHYIEARCSIKAIEAALGARQWKKAIYILDLQDRNTASKYYPLVAQHYASLQEYEIAEELYTKGDRTKDAIDMYTQAGRWEQAHKLAMKCMRPEDVSVLYITQAQEMEKQGKYREAERLYVTVQEPDLAITMYKKHKLYDDMIRLVGKHHPDLLSDTHLHLGKELEAEGRLQEAEYHYLEAQEWKATVNMYRASGLWEEAYRVARTQGGANAHKHVAYLWAKSLGGEAAVRLLNKLGLLEAAVDHAADNCSFEFAFELSRLALKHKTPEVHLKYAMFLEDEGKFEEAEAEFIRAGKPKEAVLMFVHNQDWEAAQRVAEAHDPDSVAEVLVGQARGALEEKDFQKAEGLLLRAQRPGLALNYYKEAGLWSDALRICKDYVPSQLEALQEEYEREATKKGARGVEGFVEQARHWEQAGEYSRAVDCYLKVRDSGNSGLAEKCWMKAAELSIKFLPPQRNMEVVLAVGPQLIGIGKHSAAAELYLNLDLVKEAIDAFIEGEEWNKAKRVAKELDPRYEDYVDQHYKEFLKNQGKVDSLVGVDVIAALDLYVEQGQWDKCIETATKQNYKILHKYVALYATHLIREGSSAQALALYVQHGAPANPQNFNIYKRIFTDMVSSPGTNCAEAYHSWADLRDVLFNLCENLVKSSEANSPAHEEFKTMLLIAHYYATRSAAQSVKQLETVAARLSVSLLRHTQLLPVDKAFYEAGIAAKAVGWDNMAFIFLNRFLDLTDAIEEGTLDGLDHSDFQDTDIPFEVPLPAKQHVPEAEREEVRDWVLTVSMDQRLEQVLPRDERGAYEASLVAASTGVRALPCLITGYPILRNKIEFKRPGKAANKDNWNKFLMAIKTSHSPVCQDVLKFISQWCGGLPSTSFSFQ

SEQ ID NO: 50338 - protein, 511 aa, Homo sapiens
MAWSQNNAKFAVCTVDRVVLLYDEHGERRDKFSTKPADMKYGRKSYMVKGMAFSPDSTKIAIGQTDNIIYVYKIGEDWGDKKVICNKFIQTSAVTCLQWPAEYIIVFGLAEGKVRLANTKTNKSSTIYGTESYVVSLTTNCSGKGILSGHADGTIVRYFFDDEGSGESQGKLVNHPCPPYALAWATNSIVAAGCDRKIVAYGKEGHMLQTFDYSRDPQEREFTTAVSSPGGQSVVLGSYDRLRVFNWIPRRSIWEEAKPKEITNLYTITALAWKRDGSRLCVGTLCGGVEQFDCCLRRSIYKNKFELTYVGPSQVIVKNLSSGTRVVLKSHYGYEVEEVKILGKERYLVAHTSETLLLGDLNTNRLSEIAWQGSGGNEKYFFENENVCMIFNAGELTLVEYGNNDTLGSVRTEFMNPHLISVRINERCQRGTEDNKKLAYLIDIKTIAIVDLIGGYNIGTVSHESRVDWLELNETGHKLLFRDRKLRVRRATKALGIGWPTEGVRQAATRD

SEQ ID NO: 50339 - protein, 122 aa, Homo sapiens
MTHLLLTATVTPSEQNSSREPGWETAMAKDILGEAGLHFDELNKLRVLDPEVTQQTIELKEECKDFVDKIGQFQKIVGGLIELVDQLAKEAENEKMKVRSACLPPTSWPGTLVHYPLIPLPS

SEQ ID NO: 50340 - protein, 148 aa, Homo sapiens
MAKDILGEAGLHFDELNKLRVLDPEVTQQTIELKEECKDFVDKIGQFQKIVGGLIELVDQLAKEAENEKMKSLAVSPRLECTGAISAHCKLCLSDSSDSPTSPSRVGGTTGHRCSELAQIYSKAERSSTAATSSPNSRKENAARKVSG

SEQ ID NO: 50341 - protein, 132 aa, Homo sapiens
MAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 50342 - protein, 71 aa, Homo sapiens
DILGEAGLHFDELNKLRVLDPEVTQQTIELKEECKDFVDKIGQFQKIVGGLIELVDQLAKEAENEKMKVSG

SEQ ID NO: 50343 - protein, 114 aa, Homo sapiens
MAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERNELKISLL

SEQ ID NO: 50344 - protein, 158 aa, Homo sapiens
MTHLLLTATVTPSEQNSSREPGWETAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQK

SEQ ID NO: 50345 - protein, 132 aa, Homo sapiens; identical to SEQ ID NO: 50341

SEQ ID NO: 50346 - protein, 213 aa, Homo sapiens
MEDLLDLDEELRYSLATSRAKMGRRAQQESAQAENHLNGKNSSLTLTGETSSAKLPRCRQGGWAGDSVKASNGTQTGKQQLDLNACYHKTHHRDLGLASLEEADIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 50347 - protein, 208 aa, Homo sapiens
MEDLLDLDEELRYSLATSRAKMGRRAQQESAQAENHLNGKNSSLTLTGETSSAKLPRCRQGGWAGDSVKASKFRRKASEEIEDFRLRPQSLNGSDYGGDIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 50348 - protein, 113 aa, Homo sapiens
MEDLLDLDEELRYSLATSRAKMGRRAQQESAQAENHLNGKNSSLTLTGETSSAKLPRCRQGGWAGDSVKASKFRRKASEEIEEYVSSILILMVSYVDLGQQCSLGGHDLFHLC

SEQ ID NO: 50349 - protein, 429 aa, Homo sapiens
MTAALAVVTTSGLEDGVPRSRGEGTGEVVLERGPGAAYHMFVVMEDLVEKLKLLRYEEEFLRKSNLKAPSRHYFALPTNPGEQFYMFCTLAAWLINKAGRPFEQPQEYDDPNATISNILSELRSFGRTADFPPSKLKSGYGEHVCYVLDCFAEEALKYIGFTWKRPIYPVEELEEESVAEDDAELTLNKVDEEFVEEETDNEENFIDLNVLKAQTYHLDMNETAKQEDILESTTDAAEWSLEVERVLPQLKVTIRTDNKDWRIHVDQMHQHRSGIESALKETKGFLDKLHNEITRTLEKISSREKYINNQLENLVQEYRAAQAQLSEAKERYQQGNGGVTERTRLLSEVMEELEKVKQEMEEKGSSMTDGAPLVKIKQSLTKLKQETVEMDIRIGIVEHTLLQSKLKEKSNMTRNMHATVIPEPATGFY

SEQ ID NO: 50350 - protein, 777 aa, Homo sapiens
MRLKISLLKEPKHQELVSCVGWTTAEELYSCSDDHQIVKWNLLTSETTQIVKLPDDIYPIDFHWFPKSLGVKKQTQAESFVLTSSDGKFHLISKLGRVEKSVEAHCGAVLAGRWNYEGTALVTVGEDGQIKIWSKTGMLRSTLAQQGTPVYSVAWGPDSEKVLYTAGKQLIIKPLQPNAKVLQWKAHDGIILKVDWNSVNDLILSAGEDCKYKVWDSYGRPLYNSQPHEHPITSVAWAPDGELFAVGSFHTLRLCDKTGWSYALEKPNTGSIFNIAWSIDGTQIAGACGNGHVVFAHVVEQHWEWKNFQVTLTKRRAMQVRNVLNDAVDLLEFRDRVIKASLNYAHLVVSTSLQCYVFSTKNWNTPIIFDLKEGTVSLILQAERHFLLVDGSSIYLYSYEGRFISSPKFPGMRTDILNAQTVSLSNDTIAIRDKADEKIIFLFEASTGKPLGDGKFLSHKNEILEIALDQKGLTNDRKIAFIDKNRDLCITSVKRFGKEEQIIKLGTMVHTLAWNDTCNILCGLQDTRFIVWYYPNTVYVDRDILPKTLYERDASEFSKNPHIVSFVGNQVTIRRADGSLVHISITPYPAILHEYVSSSKWEDAVRLCRFVKEQTMWACLAAMAVANRDMTTAEIAYAAIGEIDKVQYINSIKNLPSKESKMAHILLFSGNIQEAEIVLLQAGLVYQAIQININLYNWERALELAVKYKTHVDTVLAYRQKFLETFGKQETNKRYLHYAEGLQIDWEKIKAKIEMEITKEREQSSSSQSSKSIGLKP

SEQ ID NO: 50351 - protein, 64 aa, Homo sapiens
MRLKISLLKEPKHQELVSCVGWTTAEELYSCSDDHQIVKWNLLTSETTQIVKLPDDIYPIDFHW

SEQ ID NO: 50352 - protein, 640 aa, Homo sapiens
MLRSTLAQQGTPVYSVAWGPDSEKVLYTAGKQLIIKPLQPNAKVLQWKAHDGIILKVDWNSVNDLILSAGEDCKYKVWDSYGRPLYNSQPHEHPITSVAWAPDGELFAVGSFHTLRLCDKTGWSYALEKPNTGSIFNIAWSIDGTQIAGACGNGHVVFAHVVEQHWEWKNFQVTLTKRRAMQVRNVLNDAVDLLEFRDRVIKASLNYAHLVVSTSLQCYVFSTKNWNTPIIFDLKEGTVSLILQAERHFLLVDGSSIYLYSYEGRFISSPKFPGMRTDILNAQTVSLSNDTIAIRDKADEKIIFLFEASTGKPLGDGKFLSHKNEILEIALDQKGLTNDRKIAFIDKNRDLCITSVKRFGKEEQIIKLGTMVHTLAWNDTCNILCGLQDTRFIVWYYPNTVYVDRDILPKTLYERDASEFSKNPHIVSFVGNQVTIRRADGSLVHISITPYPAILHEYVSSSKWEDAVRLCRFVKEQTMWACLAAMAVANRDMTTAEIAYAAIGEIDKVQYINSIKNLPSKESKMAHILLFSGNIQEAEIVLLQAGLVYQAIQININLYNWERALELAVKYKTHVDTVLAYRQKFLETFGKQETNKRYLHYAEGLQIDWEKIKAKIEMEITKEREQSSSSQSSKSIGLKP

SEQ ID NO: 50353 - protein, 121 aa, Homo sapiens
MRLKISLLKEPKHQELVSCVGWTTAEELYSCSDDHQIVKWNLLTSETTQIVKLPDDIYPIDFHWFPKSLGVKKQTQAESFVLTSSDGKFHLISKLGRVEKSVEAHCGAVLAGRWNYEGTAL

SEQ ID NO: 50354 - protein, 640 aa, Homo sapiens; identical to SEQ ID NO: 50352

SEQ ID NO: 50355 - protein, 179 aa, Homo sapiens
MRLKISLLKEPKHQELVSCVGWTTAEELYSCSDDHQIVKWNLLTSETTQIVKLPDDIYPIDFHWFPKSLGVKKQTQAESFVLTSSDGKFHLISKLGRVEKSVEAHCGAVLAGRWNYEGTALVTVGEDGQIKIWSKTGMLRSTLAQQGTPVYSVAWGPDSEKVLYTAGKQLIIKPLQPNA

SEQ ID NO: 50356 - protein, 408 aa, Homo sapiens
MASVASCDSRPSSDELPGDPSSQEEDEDYDFEDRVSDSGSYSSASSDYDDLEPEWLDSVQKNGELFYLELSEDEEESLLPETPTVNHVRFSENEIIIEDDYKERKKYEPKLKQFTKILRRKRLLPKRCNKKNSNDNGPVSILKHQSNQKTGVIVQQRYKDVNVYVNPKKLTVIKAKEQLKLLEVLVGIIHQTKWSWRRTGKQGDGERLVVHGLLPGGSAMKSGQVLIGDVLVAVNDVDVTTENIERVLSCIPGPMQVKLTFENAYDVKRETSHPRQKKTQSNTSDLVKLLWGEEVEGIQQSGLNTPHIIMYLTLQLDSETSKEEQEILYHYPMSEASQKLKSVRGIFLTLCDMLENVTGTQVTSSSLLLNGKQIHVAYWKESDKLLLIGLPAEEIELPSSAHTHGERN

SEQ ID NO: 50357 - protein, 942 aa, Homo sapiens
MASVASCDSRPSSDELPGDPSSQEEDEDYDFEDRVSDSGSYSSASSDYDDLEPEWLDSVQKNGELFYLELSEDEEESLLPETPTVNHVRFSENEIIIEDDYKERKKYEPKLKQFTKILRRKRLLPKRCNKKNSNDNGPVSILKHQSNQKTGVIVQQRYKDVNVYVNPKKLTVIKAKEQLKLLEVLVGIIHQTKWSWRRTGKQGDGERLVVHGLLPGGSAMKSGQVLIGDVLVAVNDVDVTTENIERVLSCIPGPMQVKLTFENAYDVKRETSHPRQKKTQSNTSDLVKLLWGEEVEGIQQSGLNTPHIIMYLTLQLDSETSKEEQEILYHYPMSEASQKLKSVRGIFLTLCDMLENVTGTQVTSSSLLLNGKQIHVAYWKESDKLLLIGLPAEEVPLPRLRNMIENVIQTLKFMYGSLDSAFCQIENVPRLDHFFNLFFQRALQPAKLHSSASPSAQQYDASSAVLLDNLPGVRWLTLPLEIKMELDMALSDLEAADFAELSEDYYDMRRLYTILGSSLFYKGYLICSHLPKDDLIDIAVYCRHYCLLPLAAKQRIGQLIIWREVFPQHHLRPLADSSTEVFPEPEGRYFLLVVGLKHYMLCVLLEAGGCASKAIGSPGPDCVYVDQVKTTLHQLDGVDSRIDERLASSPVPCLSCADWFLTGSREKTDSLTTSPILSRLQGTSKVATSPTCRRTLFGDYSLKTRKPSPSCSSGGSDNGCEGGEDDGFSPHTTPDAVRKQRESQGSDGLEESGTLLKVTKKKSTLPNPFHLGNLKKDLPEKELEIYNTVKLTSGPENTLFHYVALETVQGIFITPTLEEVAQLSGSIHPQLIKNFHQCCLSIRAVFQQTLVEEKKKGLNSGDHSDSAKSVSSLNPVKEHGVLFECSPGNWTDQKKAPPVMAYWVVGRLFLHPKPQELYVCFHDSVTEIAIEIAFKLFFGLTL

SEQ ID NO: 50358 - protein, 895 aa, Homo sapiens
MNKSENLLFAGSSLASQVHAAAVNGDKGALQRLIVGNSALKDKEDQFGRTPLMYCVLADRLDCADALLKAGADVNKTDHSQRTALHLAAQKGNYRFMKLLLTRRANWMQKDLEEMTPLHLTTRHRSPKCLALLLKFMAPGEVDTQDKNKQTALHWSAYYNNPEHVKLLIKHDSNIGIPDVEGKIPLHWAANHKDPSAVHTVRCILDAAPTESLLNWQDYEGRTPLHFAVADGNVTVVDVLTSYESCNITSYDNLFRTPLHWAALLGHAQIVHLLLERNKSGTIPSDSQGATPLHYAAQSNFAETVKVFLKHPSVKDDSDLEGRTSFMWAAGKGSDDVLRTMLSLKSDIDINMADKYGGTALHAAALSGHVSTVKLLLENNAQVDATDVMKHTPLFRACEMGHKDVIQTLIKGGARVDLVDQDGHSLLHWAALGGNADVCQILIENKINPNVQDYAGRTPLQCAAYGGYINCMAVLMENNADPNIQDKEGRTALHWSCNNGYLDAIKLLLDFAAFPNQMENNEERYTPLDYALLGERHEVIQFMLEHGALSIAAIQDIAAFKIQAVYKGYKVRKAFRDRKNLLMKHEQLRKDAAAKKREEENKRKEAEQQKGRRSPDSCRPQALPCLPSTQDVPSRQSRAPSKQPPAGNVAQGPEPRDSRGSPGGSLGGALQKEQHVSSDLQGTNSRRPNETAREHSKGQSACVHFRPNEGSDGSRHPGVPSVEKSRELRLQIIQRERRRKELFRKKNKAAAVIQRAWRSYQLRKHLSHLRHMKQLGAGDVDRWRQESTALLLQVWRKELELKFPQTTAVSKAPKSPSKGTSGTKSTKHSVLKQIYGCSHEGKIHHPTRSVKASSVLRLNSVSNLQCIHLLENSGRSKNFSYNLQSATQPKNKTKP

SEQ ID NO: 50359 - protein, 1065 aa, Homo sapiens
MNKSENLLFAGSSLASQVHAAAVNGDKGALQRLIVGNSALKDKEDQFGRTPLMYCVLADRLDCADALLKAGADVNKTDHSQRTALHLAAQKGNYRFMKLLLTRRANWMQKDLEEMTPLHLTTRHRSPKCLALLLKFMAPGEVDTQDKNKQTALHWSAYYNNPEHVKLLIKHDSNIGIPDVEGKIPLHWAANHKDPSAVHTVRCILDAAPTESLLNWQDYEGRTPLHFAVADGNVTVVDVLTSYESCNITSYDNLFRTPLHWAALLGHAQIVHLLLERNKSGTIPSDSQGATPLHYAAQSNFAETVKVFLKHPSVKDDSDLEGRTSFMWAAGKGSDDVLRTMLSLKSDIDINMADKYGGTALHAAALSGHVSTVKLLLENNAQVDATDVMKHTPLFRACEMGHKDVIQTLIKGGARVDLVDQDGHSLLHWAALGGNADVCQILIENKINPNVQDYAGRTPLQCAAYGGYINCMAVLMENNADPNIQDKEGRTALHWSCNNGYLDAIKLLLDFAAFPNQMENNEERYTPLDYALLGERHEVIQFMLEHGALSIAAIQDIAAFKIQAVYKGYKVRKAFRDRKNLLMKHEQLRKDAAAKKREEENKRKEAEQQKGRRSPDSCRPQALPCLPSTQDVPSRQSRAPSKQPPAGNVAQGPEPRDSRGSPGGSLGGALQKEQHVSSDLQGTNSRRPNETAREHSKGQSACVHFRPNEGSDGSRHPGVPSVEKSRGETAGDERCAKGKGFVKQPSCIRVAGPDEKGEDSRRAAASLPPHDSHWKPSRRHDTEPKAKCAPQKRRTQELRGGRCSPAGSSRPGSARGEAVHAGQNPPHHRTPRNKVTQAKLTGGLYSHLPQSTEELRSGARRLETSTLSEDFQVSKETDPAPGPLSGQSVNIDLLPVELRLQIIQRERRRKELFRKKNKAAAVIQRAWRSYQLRKHLSHLRHMKQLGAGDVDRWRQESTALLLQVWRKELELKFPQTTAVSKAPKSPSKGTSGTKSTKHSVLKQIYGCSHEGKIHHPTRSVKASSVLRLNSVSNLQCIHLLENSGRSKNFSYNLQSATQPKNKTKP

SEQ ID NO: 50360 - protein, 101 aa, Homo sapiens
MNKSENLLFAGSSLASQVHAAAVNGDKGALQRLIVGNSALKDKEDQFGRTPLMYCVLADRLDCADALLKAGADVNKTDHSQRTALHLAAQKALRTISTGRI

SEQ ID NO: 50361 - protein, 988 aa, Homo sapiens
MKLLLTRRANWMQKDLEEMTPLHLTTRHRSPKCLALLLKFMAPGEVDTQDKNKQTALHWSAYYNNPEHVKLLIKHDSNIGIPDVEGKIPLHWAANHKDPSAVHTVRCILDAAPTESLLNWQDYEGRTPLHFAVADGNVTVVDVLTSYESCNITSYDNLFRTPLHWAALLGHAQIVHLLLERNKSGTIPSDSQGATPLHYAAQSNFAETVKVFLKHPSVKDDSDLEGRTSFMWAAGKGSDDVLRTMLSLKSDIDINMADKYGGTALHAAALSGHVSTVKLLLENNAQVDATDVMKHTPLFRACEMGHKDVIQTLIKGGARVDLVDQDGHSLLHWAALGGNADVCQILIENKINPNVQDYAGRTPLQCAAYGGYINCMAVLMENNADPNIQDKEGRTALHWSCNNGYLDAIKLLLDFAAFPNQMENNEERYTPLDYALLGERHEVIQFMLEHGALSIAAIQDIAAFKIQAVYKGYKVRKAFRDRKNLLMKHEQLRKDAAAKKREEENKRKEAEQQKGRRSPDSCRPQALPCLPSTQDVPSRQSRAPSKQPPAGNVAQGPEPRDSRGSPGGSLGGALQKEQHVSSDLQGTNSRRPNETAREHSKGQSACVHFRPNEGSDGSRHPGVPSVEKSRGETAGDERCAKGKGFVKQPSCIRVAGPDEKGEDSRRAAASLPPHDSHWKPSRRHDTEPKAKCAPQKRRTQELRGGRCSPAGSSRPGSARGEAVHAGQNPPHHRTPRNKVTQAKLTGGLYSHLPQSTEELRSGARRLETSTLSEDFQVSKETDPAPGPLSGQSVNIDLLPVELRLQIIQRERRRKELFRKKNKAAAVIQRAWRSYQLRKHLSHLRHMKQLGAGDVDRWRQESTALLLQVWRKELELKFPQTTAVSKAPKSPSKGTSGTKSTKHSVLKQIYGCSHEGKIHHPTRSVKASSVLRLNSGKAATAKQMVGKNMGKHFPLFHPQRQKTLEQIWPGFSNGHLISWDYYCSQHLSP

SEQ ID NO: 50362 - protein, 1240 aa, Homo sapiens
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLRDLEDADLLIQLEAFEEAKAEDEEELLRVSGGVDMSSHQEVFASLFHKVSCSPVSAQLLSVLQGLLHLEPTLRSSQLLWEALESLVNRAVLLASDAQECTLEEVVERLLSVKGRPRPSPLVKAHKSVQANLDQSQRGSSPQNTTTPKPSVEGQQPAAAAACEPVDHAQSESILKVSQPRALEQQASTPPPPPPPPLLPGSSAEPPPPPPPPPLPSVGAKALPTAPPPPPLPGLGAMAPPAPPLPPPLPGSCEFLPPPPPPLPGLGCPPPPPPLLPGMGWGPPPPPPPLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEGLRPRPKAK

SEQ ID NO: 50363 - protein, 1249 aa, Homo sapiens
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLRDLEDADLLIQLEAFEEAKAEDEEELLRVSGGVDMSSHQEVFASLFHKVSCSPVSAQLLSVLQGLLHLEPTLRSSQLLWEALESLVNRAVLLASDAQECTLEEVVERLLSVKGRPRPSPLVKAHKSVQANLDQSQRGSSPQNTTTPKPSVEGQQPAAAAACEPVDHAQSESILKVSQPRALEQQASTPPPPPPPPLLPGSSAEPPPPPPPPPLPSVGAKALPTAPPPPPLPGLGAMAPPAPPLPPPLPGSCEFLPPPPPPLPGLGCPPPPPPLLPGMGWGPPPPPPPLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEEVPPDSDDNKTKKLCVIQ

SEQ ID NO: 50364 - protein, 234 aa, Homo sapiens
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLR

SEQ ID NO: 50365 - protein, 585 aa, Homo sapiens
MSQQHTLPVTLSPALSQELLKTVPPPVNTHQEQMKQPTPLPPPCQKVPVELPVEVPSKQEEKHMTAVKGLPEQECEQQQKEPQEQELQQQHWEQHEEYQKAENPEQQLKQEKTQRDQQLNKQLEEEKKLLDQQLDQELVKRDEQLGMKKEQLLELPEQQEGHLKHLEQQEGQLKHPEQQEGQLELPEQQEGQLELPEQQEGQLELPEQQEGQLELPEQQEGQLELPEQQEGQLELPQQQEGQLELSEQQEGQLELSEQQEGQLKHLEHQEGQLEVPEEQMGQLKYLEQQEGQLKHLDQQEKQPELPEQQMGQLKHLEQQEGQPKHLEQQEGQLEQLEEQEGQLKHLEQQEGQLEHLEHQEGQLGLPEQQVLQLKQLEKQQGQPKHLEEEEGQLKHLVQQEGQLKHLVQQEGQLEQQERQVEHLEQQVGQLKHLEEQEGQLKHLEQQQGQLEVPEQQVGQPKNLEQEEKQLELPEQQEGQVKHLEKQEAQLELPEQQVGQPKHLEQQEKHLEHPEQQDGQLKHLEQQEGQLKDLEQQKGQLEQPVFAPAPGQVQDIQPALPTKGEVLLPVEHQQQKQEVQWPPKHK

SEQ ID NO: 50366 - protein, 439 aa, Homo sapiens
MKKEQLLELPEQQEGHLKHLEQQEGQLKHPEQQEGQLELPEQQEGQLELPEQQEGQLELPEQQEGQLELPEQQEGQLELPEQQEGQLELPQQQEGQLELSEQQEGQLELSEQQEGQLKHLEHQEGQLEVPEEQMGQLKYLEQQEGQLKHLDQQEKQPELPEQQMGQLKHLEQQEGQPKHLEQQEGQLEQLEEQEGQLKHLEQQEGQLEHLEHQEGQLGLPEQQVLQLKQLEKQQGQPKHLEEEEGQLKHLVQQEGQLKHLVQQEGQLEQQERQVEHLEQQVGQLKHLEEQEGQLKHLEQQQGQLEVPEQQVGQPKNLEQEEKQLELPEQQEGQVKHLEKQEAQLELPEQQVGQPKHLEQQEKHLEHPEQQDGQLKHLEQQEGQLKDLEQQKGQLEQPVFAPAPGQVQDIQPALPTKGEVLLPVEHQQQKQEVQWPPKHK

SEQ ID NO: 50367 - protein, 293 aa, Homo sapiens
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQVNNGITMRHQTARHRHLIEGPGRSSEACSKLSSQGCPECRSGDCHYHSSQLWPSTEGAPGPPRT

SEQ ID NO: 50368 - protein, 289 aa, Homo sapiens
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQNAGLVTVTTTPLNCGPRLRVLLGRPAHEKLLMLLPVGYPSKEATVPDLKRKPLDQIMVTV

SEQ ID NO: 50369 - protein, 270 aa, Homo sapiens
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQVNNGITMRHQTARHRHLIEGPGRSSEACSKLSSQGCPGFYC

SEQ ID NO: 50370 - protein, 247 aa, Homo sapiens
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQVFGKIILKELALISFLNL

SEQ ID NO: 50371 - protein, 284 aa, Homo sapiens
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQVNNGITMRHQTARHRHLIEGPGRSSEACSKLSSQGCPGASAAGSLFHFAIEFAAP

SEQ ID NO: 50372 - protein, 949 aa, Homo sapiens
MEPPGRSSRSTASHTLHQYCCPTQVLDSMKLTPSGRLAESSVEGDAPGSDLSTAVDSPGSQPPYRLSQLPPSSSHMGGPPAGVGLPWAQRARLQPASVALRKQEEEEIKRSKALSDSYELSTDLQDKKVEMLERKYGGSFLSRRAARTIQTAFRQYRMNKNFERLRSSASESRMSRRIILSNMRMQFSFEEYEKAQNPAYFEGKPASLDEGAMAGARSHRLERGLPYGGSCGGGIDGGGSSVTTSGEFSNDITELEDSFSKQVKSLAESIDEALNCHPSGPMSEEPGSAQLEKRESKEQQEDSSATSFSDLPLYLDDTVPQQSPERLPSTEPPPQGRPEFWAPAPLPPVPPPVPSGTREDGSREEGTRRGPGCLECRDFRLRAAHLPLLTIEPPSDSSVDLSDRSDRGSVHRQLVYEADGCSPHGTLKHKGPPGRAPIPHRHYPAPEGPAPAPPGPLPPAPNSGTGPSGVAGGRRLGKCEAAGENSDGGDNESLESSSNSNETINCSSGSSSRDSLREPPATGLCKQTYQRETRHSWDSPAFNNDVVQRRHYRIGLNLFNKKPEKGIQYLIERGFLSDTPVGVAHFILERKGLSRQMIGEFLGNRQKQFNRDVLDCVVDEMDFSSMDLDDALRKFQSHIRVQGEAQKVERLIEAFSQRYCVCNPALVRQFRNPDTIFILAFAIILLNTDMYSPSVKAERKMKLDDFIKNLRGVDNGEDIPRDLLVGIYQRIQGRELRTNDDHVSQVQAVERMIVGKKPVLSLPHRRLVCCCQLYEVPDPNRPQRLGLHQREVFLFNDLLVVTKIFQKKKILVTYSFRQSFPLVEMHMQLFQNSYYQFGIKLLSAVPGGERKVLIIFNAPSLQDRLRFTSDLRESIAEVQEMEKYRVESELEKQKGMMRPNASQPGGAKDSVNGTMARSSLEDTYGAGDGLKRGALSSSLRDLSDAGVCY

SEQ ID NO: 50373 - protein, 1478 aa, Homo sapiens
MEAGSGPPGGPGSESPNRAVEYLLELNNIIESQQQLLETQRRRIEELEGQLDQLTQENRDLREESQLHRGELHRDPHGARDSPGRESQYQNLRETQFHHRELRESQFHQAARDVGYPNREGAYQNREAVYRDKERDASYPLQDTTGYTARERDVAQCHLHHENPALGRERGGREAGPAHPGREKEAGYSAAVGVGPRPPRERGQLSRGASRSSSPGAGGGHSTSTSTSPATTLQRNVEGDAPGSDLSTAVDSPGSQPPYRLSQLPPSSSHMGGPPAGVGLPWAQRARLQPASVALRKQEEEEIKRSKALSDSYELSTDLQDKKVEMLERKYGGSFLSRRAARTIQTAFRQYRMNKNFERLRSSASESRMSRRIILSNMRMQFSFEEYEKAQNPAYFEGKPASLDEGAMAGARSHRLERGLPYGGSCGGGIDGGGSSVTTSGEFSNDITELEDSFSKQVKSLAESIDEALNCHPSGPMSEEPGSAQLEKRESKEQQEDSSATSFSDLPLYLDDTVPQQSPERLPSTEPPPQGRPEFWAPAPLPPVPPPVPSGTREDGSREEGTRRGPGCLECRDFRLRAAHLPLLTIEPPSDSSVDLSDRSDRGSVHRQLVYEADGCSPHGTLKHKGPPGRAPIPHRHYPAPEGPAPAPPGPLPPAPNSGTGPSGVAGGRRLGKCEAAGENSDGGDNESLESSSNSNETINCSSGSSSRDSLREPPATGLCKQTYQRETRHSWDSPAFNNDVVQRRHYRIGLNLFNKKPEKGIQYLIERGFLSDTPVGVAHFILERKGLSRQMIGEFLGNRQKQFNRDVLDCVVDEMDFSSMDLDDALRKFQSHIRVQGEAQKVERLIEAFSQRYCVCNPALVRQFRNPDTIFILAFAIILLNTDMYSPSVKAERKMKLDDFIKNLRGVDNGEDIPRDLLVGIYQRIQGRELRTNDDHVSQVQAVERMIVGKKPVLSLPHRRLVCCCQLYEVPDPNRPQRLGLHQREVFLFNDLLVVTKIFQKKKILVTYSFRQSFPLVEMHMQLFQNSYYQFGIKLLSAVPGGERKVLIIFNAPSLQDRLRFTSDLRESIAEVQEMEKYRVESELEKQKGMMRPNASQPGGAKDSVNGTMARSSLEDTYGAGDGLKRGALSSSLRDLSDAGKRGRRNSVGSLDSTIEGSVISSPRPHQRMPPPPPPPPPEEYKSQRPVSNSSSFLGSLFGSKRGKGPFQMPPPPTGQASASSSSASSTHHHHHHHHHGHSHGGLGVLPDGQSKLQALHAQYCQGPGPAPPPYLPPQQPSLPPPPQQPPPLPQLGSIPPPPASAPPVGPHRHFHAHGPVPGPQHYTLGRPGRAPRRGAGGHPQFAPHGRHPLHQPTSPLPLYSPAPQHPPAHKQGPKHFIFSHHPQMMPAAGAAGGPGSRPPGGSYSHPHHPQSPLSPHSPIPPHPSYPPLPPPSPHTPHSPLPPTSPHGPLHASGPPGTANPPSANPKAKPSRISTVV

SEQ ID NO: 50374 - protein, 1488 aa, Homo sapiens
MEAGSGPPGGPGSESPNRAVEYLLELNNIIESQQQLLETQRRRIEELEGQLDQLTQENRDLREESQLHRGELHRDPHGARDSPGRESQYQNLRETQFHHRELRESQFHQAARDVGYPNREGAYQNREAVYRDKERDASYPLQDTTGYTARERDVAQCHLHHENPALGRERGGREAGPAHPGREKEAGYSAAVGVGPRPPRERGQLSRGASRSSSPGAGGGHSTSTSTSPATTLQRKSDGENSRTVSVEGDAPGSDLSTAVDSPGSQPPYRLSQLPPSSSHMGGPPAGVGLPWAQRARLQPASVALRKQEEEEIKRSKALSDSYELSTDLQDKKVEMLERKYGGSFLSRRAARTIQTAFRQYRMNKNFERLRSSASESRMSRRIILSNMRMQFSFEEYEKAQNPAYFEGKPASLDEGAMAGARSHRLERGLPYGGSCGGGIDGGGSSVTTSGEFSNDITELEDSFSKQVKSLAESIDEALNCHPSGPMSEEPGSAQLEKRESKEQQEDSSATSFSDLPLYLDDTVPQQSPERLPSTEPPPQGRPEFWAPAPLPPVPPPVPSGTREDGSREEGTRRGPGCLECRDFRLRAAHLPLLTIEPPSDSSVDLSDRSDRGSVHRQLVYEADGCSPHGTLKHKGPPGRAPIPHRHYPAPEGPAPAPPGPLPPAPNSGTGPSGVAGGRRLGKCEAAGENSDGGDNESLESSSNSNETINCSSGSSSRDSLREPPATGLCKQTYQRETRHSWDSPAFNNDVVQRRHYRIGLNLFNKKPEKGIQYLIERGFLSDTPVGVAHFILERKGLSRQMIGEFLGNRQKQFNRDVLDCVVDEMDFSSMDLDDALRKFQSHIRVQGEAQKVERLIEAFSQRYCVCNPALVRQFRNPDTIFILAFAIILLNTDMYSPSVKAERKMKLDDFIKNLRGVDNGEDIPRDLLVGIYQRIQGRELRTNDDHVSQVQAVERMIVGKKPVLSLPHRRLVCCCQLYEVPDPNRPQRLGLHQREVFLFNDLLVVTKIFQKKKILVTYSFRQSFPLVEMHMQLFQNSYYQFGIKLLSAVPGGERKVLIIFNAPSLQDRLRFTSDLRESIAEVQEMEKYRVESELEKQKGMMRPNASQPGGAKDSVNGTMARSSLEDTYGAGDGLKRGALSSSLRDLSDAGKRGRRNSVGSLDSTIEGSVISSPRPHQRMPPPPPPPPPEEYKSQRPVSNSSSFLGSLFGSKRGKGPFQMPPPPTGQASASSSSASSTHHHHHHHHHGHSHGGLGVLPDGQSKLQALHAQYCQGPGPAPPPYLPPQQPSLPPPPQQPPPLPQLGSIPPPPASAPPVGPHRHFHAHGPVPGPQHYTLGRPGRAPRRGAGGHPQFAPHGRHPLHQPTSPLPLYSPAPQHPPAHKQGPKHFIFSHHPQMMPAAGAAGGPGSRPPGGSYSHPHHPQSPLSPHSPIPPHPSYPPLPPPSPHTPHSPLPPTSPHGPLHASGPPGTANPPSANPKAKPSRISTVV

SEQ ID NO: 50375 - protein, 1182 aa, Homo sapiens
MESLLENPVRAVLYLKELTAIVQNQQSLIHTQRERIDELERRLDELSAENRSLWEHQQLLQAQPPPGLVPPSSAPLPAAPATAPAAAARAQEPLQDQGQRSAAAPHPAPDRPPRQHHGQLLEQPQRGPGSRAHTPQSPHKHLGTQGAVTDKEKERPPSCCAAAGALLQHKSPSALGKGVLSRRPENETVLHQFCCPAADACSDLASQSDGSCTQAGGGMEDSVVAAAAVAAGRPSAHAPKAQAQELQEEEERPGAGAASPRAGPQHKASPGRQQPALATALCPHAPAASDYELSLDLKNKQIEMLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVSIHNRLQTSQHNSGLGAERGAPVPPPDLQPSPPRQQTPPLPPPPPTPPGTLVQCQQIVKVIVLDKPCLARMEPLLSQALSCYTSSSSDSCGSTPLGGPGSPVKVTHQPPLPPPPPPYNHPHQFCPPGSLLHGHRYSSGSRSLV

SEQ ID NO: 50376 - protein, 759 aa, Homo sapiens
MLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVLINASPARLTILPISRDTIKSYC

SEQ ID NO: 50377 - protein, 1182 aa, Homo sapiens; identical to SEQ ID NO: 50375

SEQ ID NO: 50378 - protein, 598 aa, Homo sapiens
MKPTGTDPRILSIAAEVAKSPEQNVPVILLKLKEIINITPLGSSELKKIKQDIYCYDLIQYCLLVLSQDYSRIQGGWTTISQLTQILSHCCVGLEPGEDAEEFYNELLPSAAENFLVLGRQLQTCFINAAKAEEKDELLHFFQIVTDSLFWLLGGHVELIQNVLQSDHFLHLLQADNVQIGSAVMMMLQNILQINSGDLLRIGRKALYSILDEVIFKLFSTPSPVIRSTATKLLLLMAESHQEILILLRQSTCYKGLRRLLSKQETGTEFSQELRQLVGLLSPMVYQEVEEQKLHQAACLIQAYWKGFQTRKRLKKLPSAVIALQRSFRSKRSKMLLEINRQKEEEDLKLQLQLQRQRAMRLSRELQLSMLEIVHPGQVEKHYREMEEKSALIIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 50379 - protein, 465 aa, Homo sapiens
MKPTGTDPRILSIAAEVAKSPEQNVPVILLKLKEIINITPLGSSELKKIKQDIYCYDLIQYCLLVLSQDYSRIQGGWTTISQLTQILSHCCVGLEPGEDAEEFYNELLPSAAENFLVLGRQLQTCFINAAKAEEKDELLHFFQIVTDSLFWLLGGHVELIQNVLQSDHFLHLLQADNVQIGSAVMMMLQNILQINRSKRSKMLLEINRQKEEEDLKLQLQLQRQRAMRLSRELQLSMLEIVHPGQVEKHYREMEEKSALIIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 50380 - protein, 87 aa, Homo sapiens
MKPTGTDPRILSIAAEVAKSPEQNVPVILLKLKEIINITPLGSSELKKIKQDIYCYDLIQYCLLVLSQDYSRIQGGWTTISQLTQIL

SEQ ID NO: 50381 - protein, 443 aa, Homo sapiens
MEEDSLEDSNLPPKVWHSEMTVSVTGEPPSTVEEEGIPKETDIEIIPEIPETLEPLSLPDVLRISAVLEDTTDQLSILNYIMPVQYEGRQSICVKSREMNLEGTNLDKLPMASTITKIPSPLITEEGPNLPEIRHRGRFAVEFNKMQDLVFKKPTRQTIMTTETLKKIQIDRQFFSDVIADTIKELQDSATYNSLLQALSKERENKMHFYDIIAREEKGRKQIISLQKQLINVKKEWQFEVQSQNEYIANLKDQLQEMKAKSNLENRYMKTNTELQIAQTQKKCNRTEELLVEEIEKLRMKTEEEARTHTEIEMFLRKEQQKLEERLEFWMEKYDKDTEMKQNELNALKATKASDLAHLQDLAKMIREYEQVIIEDRIEKERSKKKVKQDLLELKSVIKLQAWWRGTMIRREIGGFKMPKDKVDSKDSKGKGKGKDKRRGKKK

SEQ ID NO: 50382 - protein, 54 aa, Homo sapiens
MEEDSLEDSNLPPKVWHSEMTVSVTGEPPSTVEEEGIPKETDIEIIPEIPETLE

SEQ ID NO: 50383 - protein, 443 aa, Homo sapiens; identical to SEQ ID NO: 50381

SEQ ID NO: 50384 - protein, 1657 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 50385 - protein, 1575 aa, Homo sapiens
MPHEELPSLQRPRYGSIVDDERLSAEEMDERRRQNIAYEYLCHLEEAKRWMEVCLVEELPPTTELEEGLRNGVYLAKLAKFFAPKMVSEKKIYDVEQTRYKKSGLHFRHTDNTVQWLRAMESIGLPKIFYPETTDVYDRKNIPRMIYCIHALSLYLFKLGIAPQIQDLLGKVDFTEEEISNMRKELEKYGIQMPSFSKIGGILANELSVDEAALHAAVIAINEAVEKGIAEQTVVTLRNPNAVLTLVDDNLAPEYQKELWDAKKKKEENARLKNSCISEEERDAYEELLTQAEIQGNINKVNRQAAVDHINAVIPEGDPENTLLALKKPEAQLPAVYPFAAAMYQNELFNLQKQNTMNYLAHEELLIAVEMLSAVALLNQALESNDLVSVQNQLRSPAIGLNNLDKAYVERYANTLLSVKLEVLSQGQDNLSWNEIQNCIDMVNAQIQEENDRVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 50386 - protein, 1077 aa, Homo sapiens
MVNAQIQEENDRVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 50387 - protein, 1071 aa, Homo sapiens
MHSLPGVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 50388 - protein, 377 aa, Homo sapiens
MGCFKGVVAVGYINEAIDEGNPLRTLETLLLPTANISDVDPAHAQHYQDVLYHAKSQKLGDSESVSKVLWLDEIQQAVDDANVDKDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKT

SEQ ID NO: 50389 - protein, 1027 aa, Homo sapiens
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKIKVSKLIKGSNISSLTVLPSSHCTDPYFTPIPVLQADAHKGILSMIERGLIPPTARITFQNPPITPRAAPLHSFDEARKIPTVATFTIPREPPPSPAEVKFFPKKQRSKGKSRRSRGHHDRKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPKHHMCLATHLMYSPKAIKRIKNLIRGTEAYIVSGLLHRDDLAVADMLDIPILGSEPELAHLYSTKSGGKRVFDSANVAVPPGIYDIYSQQQMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDVEERQGTVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 50390 - protein, 696 aa, Homo sapiens
MIERGLIPPTARITFQNPPITPRAAPLHSFDEARKIPTVATFTIPREPPPSPAEVKFFPKKQRSKGKSRRSRGHHDRKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDVENNRRGSPGGPHDLCSPSLHHPSRNIST

SEQ ID NO: 50391 - protein, 621 aa, Homo sapiens
MTKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDVENNRRGSPGGPHDLCSPSLHHPSRNIST

SEQ ID NO: 50392 - protein, 684 aa, Homo sapiens
MKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDVEERQGTVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 50393 - protein, 168 aa, Homo sapiens
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKRKIGLNVKILQDPENIHHRAAVNANYGISLPYINQRKAC

SEQ ID NO: 50394 - protein, 112 aa, Homo sapiens
MRLEELKRLQNPLEQVNDGKYSFENHQLAMDAENNIEKYPLNLQPLESKVKIIQRAWREYLQRQEPLGKRSPSPPSVSSEKLSSSVSMNTFSDSSTPVSVMFLFLCPDLTFN

SEQ ID NO: 50395 - protein, 159 aa, Homo sapiens
MRLEELKRLQNPLEQVNDGKYSFENHQLAMDAENNIEKYPLNLQPLESKVKIIQRAWREYLQRQEPLGKRSPSPPSVSSEKLSSSVSMNTFSDSSTPFARAPVGKIHPYISWRLQSPGDKLPGGRKVILLYLDQLARPTGFIHTLKEPQIERLGFLTLQ

SEQ ID NO: 50396 - protein, 132 aa, Homo sapiens
MRLEELKRLQNPLEQVNDGKYSFENIQRAWREYLQRQEPLGKRSPSPPSVSSEKLSSSVSMNTFSDSSTPFARAPVGKIHPYISWRLQSPGDKLPGGRKVILLYLDQLARPTGFIHTLKEPQIERLGFLTLQ

SEQ ID NO: 50397 - protein, 963 aa, Homo sapiens
MDAPKAGYAFEYLIETLNDSSHKKFFDVSKLGTKYDVLPYSIRVLLEAAVRNCDGFLMKKEDVMNILDWKTKQSNVEVPFFPARVLLQDFTGIPAMVDFAAMREAVKTLGGDPEKVHPACPTDLTVDHSLQIDFSKCAIQNAPNPGGGDLQKAGKLSPVKVQPKKLPCRGQTTCRGSCDSGELGRNSGTFSSQIENTPILCPFHLQPVPEPETVLKNQEVEFGRNRERLQFFKWSSRVFKNVAVIPPGTGMAHQINLEYLSRVVFEEKDLLFPDSVVGTDSHITMVNGLGILGWGVGGIETEAVMLGLPVSLTLPEVVGCELTGSSNPFVTSIDVVLGITKHLRQVGVAGKFVEFFGSGVSQLSIVDRTTIANMCPEYGAILSFFPVDNVTLKHLEHTGFSKAKLESMETYLKAVKLFRNDQNSSGEPEYSQVIQINLNSIVPSVSGPKRPQDRVAVTDMKSDFQACLNEKVGFKGFQIAAEKQKDIVSIHYEGSEYKLSHGSVVIAAVISCTNNCNPSVMLAAGLLAKKAVEAGLRVKPYIRTSLSPGSGMVTHYLSSSGVLPYLSKLGFEIVGYGCSICVGNTAPLSDAVLNAVKQGDLVTCGILSGNKNFEGRLCDCVRANYLASPPLVVAYAIAGTVNIDFQTEPLGTDPTGKNIYLHDIWPSREEVHRVEEEHVILSMFKALKDKIEMGNKRWNSLEAPDSVLFPWDLKSTYIRCPSFFDKLTKEPIALQAIENAHVLLYLGDSVTTDHISPAGSIARNSAAAKYLTNRGLTPREFNSYGARRGNDAVMTRGTFANIKLFNKFIGKPAPKTIHFPSGQTLDVFEAAELYQKEGIPLIILAGKKYGSGNSRDWAAKGPYLLGVKAVLAESYEKIHKDHLIGIGIAPLQFLPGENADSLGLSGRETFSLTFPEELSPGITLNIQTSTGKVFSVIASFEDDVEITLYKHGGLLNFVARKFS

SEQ ID NO: 50398 - protein, 31 aa, Homo sapiens
MDYVEDKLSSEFVFNNPNIKGTCGCGESFNI

SEQ ID NO: 50399 - protein, 86 aa, Homo sapiens
MSASLVRATVRAVSKRKLQPTRAALTLTPSAVNKIKQLLKDKPEHVGVKVGVRTRGCNGLSYTLEYTKTKGDSDEEVIQDGWSAVV

SEQ ID NO: 50400 - protein, 129 aa, Homo sapiens
MSASLVRATVRAVSKRKLQPTRAALTLTPSAVNKIKQLLKDKPEHVGVKVGVRTRGCNGLSYTLEYTKTKGDSDEEVIQDGVRVFIEKKAQLTLLGTEMDYVEDKLSSEFVFNNPNIKGTCGCGESFNI

SEQ ID NO: 50401 - protein, 176 aa, Homo sapiens
MVAAGGGARTEGAVRRSLWRQCARRVHGEKLRRPTFGPRHRGAGTAKMSASLVRATVRAVSKRKLQPTRAALTLTPSAVNKIKQLLKDKPEHVGVKVGVRTRGCNGLSYTLEYTKTKGDSDEEVIQDGVRVFIEKKAQLTLLGTEMDYVEDKLSSEFVFNNPNIKGTCGCGESFNI

SEQ ID NO: 50402 - protein, 167 aa, Homo sapiens
MAAAGAFRLRRAASALLLRSPRLPARELSAPARLYHKKVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSMLAEDAIKAALADYKLKQEPKKGEAEKK

SEQ ID NO: 50403 - protein, 129 aa, Homo sapiens
MVLIDMSVDLSTQVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSKSVLFPAEEKTQLSP

SEQ ID NO: 50404 - protein, 142 aa, Homo sapiens
MVLIDMSVDLSTQVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSMLAEDAIKAALADYKLKQEPKKGEAEKK

SEQ ID NO: 50405 - protein, 480 aa, Homo sapiens
MSFPQLGYPQYLSAAGPGAYGGERPGVLAAAAAAAAAASSGRPGAAELGGGAGAAAVTSVLGMYAAAGPYAGAPNYSAFLPYAADLSLFSQMGSQYELKDNPGVHPATFAAHTAPAYYPYGQFQYGDPGRPKNATRESTSTLKAWLNEHRKNPYPTKGEKIMLAIITKMTLTQVSTWFANARRRLKKENKVTWGARSKDQEDGALFGSDTEGDPEKAEDDEEIDLESIDIDKIDEHDGDQSNEDDEDKAEAPHAPAAPSALARDQGSPLAAADVLKPQDSPLGLAKEAPEPGSTRLLSPGAAAGGLQGAPHGKPKIWSLAETATSPDGAPKASPPPPAGHPGAHGPSAGAPLQHPAFLPSHGLYTCHIGKFSNWTNSAFLAQGSLLNMRSFLGVGAPHAAPHGPHLPAPPPPQPPVAIAPGALNGDKASVRSSPTLPERDLVPRPDSPAQQLKSPFQPVRDNSLAPQEGTPRILAALPSA

SEQ ID NO: 50406 - protein, 471 aa, Homo sapiens
MSYPQGYLYQAPGSLALYSCPAYGASALAAPRSEELARSASGSAFSPYPGSAAFTAQAATGFGSPLQYSADAAAAAAGFPSYMGAPYDAHTTGMTGAISYHPYGSAAYPYQLNDPAYRKNATRDATATLKAWLNEHRKNPYPTKGEKIMLAIITKMTLTQVSTWFANARRRLKKENKMTWAPRNKSEDEDEDEGDATRSKDESPDKAQEGTETSAEDEGISLHVDSLTDHSCSAESDGEKLPCRAGDPLCESGSECKDKYDDLEDDEDDDEEGERGLAPPKPVTSSPLTGLEAPLLSPPPEAAPRGGRKTPQGSRTSPGAPPPASKPKLWSLAEIATSDLKQPSLGPGCGPPGLPAAAAPASTGAPPGGSPYPASPLLGRPLYYTSPFYGNYTNYGNLNAALQGQGLLRYNSAAAAPGEALHTAPKAASDAGKAGAHPLESHYRSPGGGYEPKKDASEGCTVVGGGVQPYL

SEQ ID NO: 50407 - protein, 471 aa, Homo sapiens; identical to SEQ ID NO: 50406

SEQ ID NO: 50408 - protein, 501 aa, Homo sapiens
MSFPQLGYQYIRPLYPSERPGAAGGSGGSAGARGGLGAGASELNASGSLSNVLSSVYGAPYAAAAAAAAAQGYGAFLPYAAELPIFPQLGAQYELKDSPGVQHPAAAAAFPHPHPAFYPYGQYQFGDPSRPKNATRESTSTLKAWLNEHRKNPYPTKGEKIMLAIITKMTLTQVSTWFANARRRLKKENKMTWAPRSRTDEEGNAYGSEREEEDEEEDEEDGKRELELEEEELGGEEEDTGGEGLADDDEDEEIDLENLDGAATEPELSLAGAARRDGDLGLGPISDSKNSDSEDSSEGLEDRPLPVLSLAPAPPPVAVASPSLPSPPVSLDPCAPAPAPASALQKPKIWSLAETATSPDNPRRSPPGAGGSPPGAAVAPSALQLSPAAAAAAAHRLVSAPLGKFPAWTNRPFPGPPPGPRLHPLSLLGSAPPHLLGLPGAAGHPAAAAAFARPAEPEGGTDRCSALEVEKKLLKTAFQPVPRRPQNHLDAALVLSALSSS

SEQ ID NO: 50409 - protein, 519 aa, Homo sapiens
MSYPQFGYPYSSAPQFLMATNSLSTCCESGGRTLADSGPAASAQAPVYCPVYESRLLATARHELNSAAALGVYGGPYGGSQGYGNYVTYGSEASAFYSLNSFDSKDGSGSAHGGLAPAAAAYYPYEPALGQYPYDRYGTMDSGTRRKNATRETTSTLKAWLQEHRKNPYPTKGEKIMLAIITKMTLTQVSTWFANARRRLKKENKMTWPPRNKCADEKRPYAEGEEEEGGEEEAREEPLKSSKNAEPVGKEEKELELSDLDDFDPLEAEPPACELKPPFHSLDGGLERVPAAPDGPVKEASGALRMSLAAGGGAALDEDLERARSCLRSAAAGPEPLPGAEGGPQVCEAKLGFVPAGASAGLEAKPRIWSLAHTATAAAAAATSLSQTEFPSCMLKRQGPAAPAAVSSAPATSPSVALPHSGALDRHQDSPVTSLRNWVDGVFHDPILRHSTLNQAWATAKGALLDPGPLGRSLGAGANVLTAPLARAFPPAVPQDAPAAGAARELLALPKAGGKPFCA

SEQ ID NO: 50410 - protein, 519 aa, Homo sapiens; identical to SEQ ID NO: 50409

SEQ ID NO: 50411 - protein, 519 aa, Homo sapiens; identical to SEQ ID NO: 50409

SEQ ID NO: 50412 - protein, 483 aa, Homo sapiens
MSYPQGYLYQPSASLALYSCPAYSTSVISGPRTDELGRSSSGSAFSPYAGSTAFTAPSPGYNSHLQYGADPAAAAAAAFSSYVGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKGDPEGPEAGGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATSSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 50413 - protein, 146 aa, Homo sapiens [sequence omitted]

SEQ ID NO: 50414 - protein, 165 aa, Homo sapiens
MGWDLTVKMLAGNEFQVSLSSSMSVSELKAQITQKIGVHAFQQRLAVHPSGVALQDRVPLASQGLGPGSTVLLVVDKCDEPLSILVRNNKGRSSTYEVRLTQTVAHLKQQVSGLEGVQDDLFWLTFEGKPLEDQLPLGEYGLKPLSTVFMNLRLRGGGTEPGGRS

SEQ ID NO: 50415 - protein, 349 aa, Homo sapiens
MGDMGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTNIQGMTGTPMVAASPERHDGGLQANPVEVQSYQPPWKVLSDFALQSDIDQPAFQQLVNFSEGGPGSNSTGSEVASMSSQLPDTPNSMVASPIEA

SEQ ID NO: 50416 - protein, 326 aa, Homo sapiens
MGDMGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTANPVEVQSYQPPWKVLSDFALQSDIDQPAFQQLVNFSEGGPGSNSTGSEVASMSSQLPDTPNSMVASPIEA

SEQ ID NO: 50417 - protein, 89 aa, Homo sapiens
MGILKLQVFLIVLSVALNHLKATPIESHQVEKRKCNTATCATQRLANFLVHSSNNFGAILSSTNVGSNTYGKRNAVEVLKREPLNYLPL

SEQ ID NO: 50418 - protein, 79 aa, Homo sapiens
MGILKLQVFLIVLSVALNHLKATPIESHQVEKRKCNTATCATQRLANFLVHSSNNFGAILSSTNVGSNTYGKRNAVEVL

SEQ ID NO: 50419 - protein, 89 aa, Homo sapiens; identical to SEQ ID NO: 50417

SEQ ID NO: 50420 - protein, 482 aa, Homo sapiens
MSGHKCYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 50421 - protein, 257 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQLAWDQWQGPRNLKVLTKMTCCC

SEQ ID NO: 50422 - protein, 483 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 50423 - protein, 483 aa, Homo sapiens; identical to SEQ ID NO: 50422

SEQ ID NO: 50424 - protein, 483 aa, Homo sapiens; identical to SEQ ID NO: 50422

SEQ ID NO: 50425 - protein, 512 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQYLQNICLEMKANSDIKMLQKGKEGQQIGILISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 50426 - protein, 134 aa, Homo sapiens
MSGHKCYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLC

SEQ ID NO: 50427 - protein, 162 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQC

SEQ ID NO: 50428 - protein, 221 aa, Homo sapiens
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILDPRSYPGLALTSLYPQNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 50429 - protein, 205 aa, Homo sapiens
MAAARPSLGRVLPGSSVLFLCDMQEKFRHNIAYFPQIVSVAARMLKVARLLEVPVMLTEQYPQGLGPTVPELGTEGLRPLAKTCFSMVPALQQELDSRPQLRSVLLCGIEAQACILNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 50430 - protein, 135 aa, Homo sapiens
MAAARPSLGRVLPGSSVLFLCDMQEKFRHNIAYFPQIVSVAARMLKNTTLDLLDRGLQVHVVVDACSSRSQVDRLVALARMRQSGAFLSTSEGLILQLVGDAVHPQFKEIQKLIKEPAPDSGLLGLFQGQNSLLH

SEQ ID NO: 50431 - protein, 366 aa, Homo sapiens
MAGPAWISKVSRLLGAFHNPKQVTRGFTGGVQTVTLIPGDGIGPEISAAVMKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 50432 - protein, 257 aa, Homo sapiens
MNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 50433 - protein, 164 aa, Homo sapiens
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYDSAQQSRPGDHSR

SEQ ID NO: 50434 - protein, 385 aa, Homo sapiens
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLKIVTRAKSQRIAKFAFDYATKKGRGKVTAVHKANIMKLGDGLFLQCCEEVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTRDMGGYSTTTDFIKSVIGHLQTKGS

SEQ ID NO: 50435 - protein, 383 aa, Homo sapiens
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLKIVTRAKSQRIAKFAFDYATKKGRGKVTAVHKANIMKLGDGLFLQCCEEVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTSDMGGYATCHDFTEAVIAALPHP

SEQ ID NO: 50436 - protein, 233 aa, Homo sapiens
MKMGERWSSLFPFPVSPSCCFLLTQSARGVIECLKIVTRAKSQRIAKFAFDYATKKGRGKVTAVHKANIMKLGDGLFLQCCEEVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTRDMGGYSTTTDFIKSVIGHLQTKGS

SEQ ID NO: 50437 - protein, 393 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENMHTPDIGGQGTTSEAIQDVIRHIRVINGRAVEA

SEQ ID NO: 50438 - protein, 301 aa, Homo sapiens
MAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENGLVCAEPACVLQMHTPDIGGQGTTSEAIQDVIRHIRVINGRAVEA

SEQ ID NO: 50439 - protein, 380 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDNTTMQLVSRPQQFDVMVMPNLYGNIVNNVCAGLVGGPGLVAGANYGHVYAVFETATRNTGKSIANKNIANPTATLLASCMMLDHLKLHSYATSIRKAVLASMDNENVRFPSHPTLLPRPVSPCSLL

SEQ ID NO: 50440 - protein, 174 aa, Homo sapiens
MYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGEMQWIIPEIYHFWKPRWSIAPGKSKR

SEQ ID NO: 50441 - protein, 174 aa, Homo sapiens; identical to SEQ ID NO: 50440

SEQ ID NO: 50442 - protein, 1262 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 50443 - protein, 1242 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIP

SEQ ID NO: 50444 - protein, 330 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGA

SEQ ID NO: 50445 - protein, 170 aa, Homo sapiens
MAPYTPFLTELMYQNLKVLIDPVSVQDKDTLSIHYLMLPRVREELIDKKTESAVSQMQSVIELGRVIRDRKTIPIKLKGSELEITLTRGSSLPGPACAYVNLNICANGSEQGGVLLLENPKGDNRLDLLKLKSVVTSIFGVKNTELAVFHDETEIQNQTDLLSLSGKTLC

SEQ ID NO: 50446 - protein, 1262 aa, Homo sapiens; identical to SEQ ID NO: 50442

SEQ ID NO: 50447 - protein, 1152 aa, Homo sapiens
MGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 50448 - protein, 249 aa, Homo sapiens
MAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKS

SEQ ID NO: 50449 - protein, 170 aa, Homo sapiens; identical to SEQ ID NO: 50445

SEQ ID NO: 50450 - protein, 271 aa, Homo sapiens
MMVLLLQLDCLTMDIYLRDKDTLSIHYLMLPRVREELIDKKTESAVSQMQSVIELGRVIRDRKTIPIKLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 50451 - protein, 1012 aa, Homo sapiens
MRWGLRPRGPGAAALATARSLWGTPRLPCSPGWQGATKRLLVRSVSGASNHQPNSNSGRYRDTVLLPQTSFPMKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKELLKKVKFIPGSALNGMVEMMDRRPYWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYKTVIVHGFTLGEKGEKMSKSLGNVIHPDVVVNGGQDQSKEPPYGADVLRWWVADSNVFTEVAIGPSVLNAARDDISKLRNTLRFLLGNVADFNPETDSIPVNDMYVIDQYMLHLLQDLANKITELYKQYDFGKVVRLLRTFYTRELSNFYFSIIKDRLYCEKENDPKRRSCQTALVEILDVIVRSFAPILPHLAEEVFQHIPYIKEPKSVFRTGWISTSSIWKKPGLEEAVESACAMRDSFLGSIPGKNAAEYKVITVIEPGLLFEIIEMLQSEETSSTSQLNELMMASESTLLAQEPREMTADVIELKGKFLINLEGGDIREESSYKVIVMPTTKEKCPRCWKYTAESSDTLCPRCAEVVSGK

SEQ ID NO: 50452 - protein, 940 aa, Homo sapiens
MKLLGRQQPDTELEIQQKCGFSELYSWQRERKVKTEFCLHDGPPYANGDPHVGHALNKILKDIANRFHMMNGSKIHFVPGWDCHGLPIEIKVLSELGREAQNLSAMEIRKKARSFAKAAIEKQKSAFIRWGIMADWNNCYYTFDGKYEAKQLRTFYQMYDKGLVYRSYKPVFWSPSSRTALAEAELEYNPEHVSRSIYVKFPLLKPSPKLASLIDGSSPVSILVWTTQPWTIPANEAVCYMPESKYAVVKCSKSGDLYVLAADKVASVASTLETTFETISTLSGVDLENGTCSHPLIPDKASPLLPANHVTMAKGTGLVHTAPAHGMEDYGVASQHNLPMDCLVDEDGVFTDVAGPELQNKAVLEEGTDVVIKMLQTAKNLLKEEKLVHSYPYDWRTKKPVVIRASKQWFINITDIKTAAKELLKKVKFIPGSALNGMVEMMDRRPYWCISRQRVWGVPIPVFHHKTKDEYLINSQTTEHIVKLVEQHGSDIWWTLPPEQLLPKEVLSEVGGPDALEYVPGQDILDIWFDSGTSWSYVLPGPDQRADLYLEGKDQLGGWFQSSLLTSVAARKRAPYKTVIVHGFTLGEKGEKMSKSLGNVIHPDVVVNGGQDQSKEPPYGADVLRWWVADSNVFTEVAIGPSVLNAARDDISKLRNTLRFLLGNVADFNPETDSIPVNDMYVIDQYMLHLLQDLANKITELYKQYDFGKVVRLLRTFYTRELSNFYFSIIKDRLYCEKENDPKRRSCQTALVEILDVIVRSFAPILPHLAEEVFQHIPYIKEPKSVFRTGWISTSSIWKKPGLEEAVESACAMRDSFLGSIPGKNAAEYKVITVIEPGLLFEIIEMLQSEETSSTSQLNELMMASESTLLAQEPREMTADVIELKGKFLINLEGGDIREESSYKVIVMPTTKEKCPRCWKYTAESSDTLCPRCAEVVSGK

SEQ ID NO: 50453 - protein, 284 aa, Homo sapiens
MAGCAARAPPGSEARLSLATFLLGASVLALPLLTRAGLQGRTGLALYVAGLNALLLLLYRPPRYQIAIRACFLGFVFGCGTLLSFSQSSWSHFGWYMCSLSLFHYSEYLVTAVNNPKSLSLDSFLLNHSLEYTVAALSSWLEFTLENIFWPELKQITWLSVTGLLMVVFGECLRKAAMFTAGSNFNHVVQNEKSDTHTLVTSGVYAWFRHPSYVGWFYWSIGTQVMLCNPICGVSYALTVWRFFRDRTEEEEISLIHFFGEEYLEYKKRVPTGLPFIKGVKVDL

SEQ ID NO: 50454 - protein, 116 aa, Homo sapiens
MAGCAARAPPGSEARLSLATFLLGASVLALPLLTRAGLQGRTGLALYVAGLNALLLLLYRPPRYQIAIRACFLGFVFGCGTLLSFSQSSWSHFGWSHLVHPHSHCRIFPYTMISVP

SEQ ID NO: 50455 - protein, 188 aa, Homo sapiens
MCSLSLFHYSEYLVTAVNNPKSLSLDSFLLNHSLEYTVAALSSWLEFTLENIFWPELKQITWLSVTGLLMVVFGECLRKAAMFTAGSNFNHVVQNEKSDTHTLVTSGVYAWFRHPSYVGWFYWSIGTQVMLCNPICGVSYALTVWRFFRDRTEEEEISLIHFFGEEYLEYKKRVPTGLPFIKGVKVDL

SEQ ID NO: 50456 - protein, 423 aa, Homo sapiens
MATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGGNGYINDFPMGRFLRDAKLYEIGAGTSEVRRLVIGRAFNADFH

SEQ ID NO: 50457 - protein, 396 aa, Homo sapiens
MAEMATATRLLGWRVASWRLRPPLAGFVSQRAHSLLPVDDAINGLSEEQRQEFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGGNGYINDFPMGRFLRDAKLYEIGAGTSEVRRLVIGRAFNADFH

SEQ ID NO: 50458 - protein, 426 aa, Homo sapiens
MAEMATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGGNGYINDFPMGRFLRDAKLYEIGAGTSEVRRLVIGRAFNADFH

SEQ ID NO: 50459 - protein, 571 aa, Homo sapiens
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNATPPRTPEVTPLRLELQKLPGLANTTLSTPNPDTQASASPDPRPLREEEEARLLPRTHLQAELHQHGCWTVTEPAALTPGNATPPRTQEVTPLLLELQKLPELVHATLSTPNPDNQVTIKVVEDPQAEVSIDLLAEPSNPPPQDTLSWLPALWSFLWGDYKGEEKDRAPGEKGEEKEEDEDYPSEDIEGEDQEDKEEDEEEQALWFNGTTDNWDQGWLAPGDWVFKDSVSYDYEPQKEWSPWSPCSGNCSTGKQQRTRPCGYGCTATETRTCDLPSCPGTEDKDTLGLPSEEWKLLARNATDMHDQDVDSCEKWLNCKSDFLIKYLSQMLRDLPSCPCAYPLEAMDSPVSLQDEHQGRSFRWRDASGPRERLDIYQPTARFCLRSMLSGESSTLAAQHCCYDEDSRLLTRGKGAGMPNLISTDFSPKLHFKFDTTPWILCKGDWSRLHAVLPPNNGRACTDNPLEEEYLAQLQEAKEY

SEQ ID NO: 50460 - protein, 483 aa, Homo sapiens
MTPGNATPPRTPEVTPLRLELQKLPGLANTTLSTPNPDTQASASPDPRPLREEEEARLLPRTHLQAELHQHGCWTVTEPAALTPGNATPPRTQEVTPLLLELQKLPELVHATLSTPNPDNQVTIKVVEDPQAEVSIDLLAEPSNPPPQDTLSWLPALWSFLWGDYKGEEKDRAPGEKGEEKEEDEDYPSEDIEGEDQEDKEEDEEEQALWFNGTTDNWDQGWLAPGDWVFKDSVSYDYEPQKEWSPWSPCSGNCSTGKQQRTRPCGYGCTATETRTCDLPSCPGTEDKDTLGLPSEEWKLLARNATDMHDQDVDSCEKWLNCKSDFLIKYLSQMLRDLPSCPCAYPLEAMDSPVSLQDEHQGRSFRWRDASGPRERLDIYQPTARFCLRSMLSGESSTLAAQHCCYDEDSRLLTRGKGAGMPNLISTDFSPKLHFKFDTTPWILCKGDWSRLHAVLPPNNGRACTDNPLEEEYLAQLQEAKEY

SEQ ID NO: 50461 - protein, 490 aa, Homo sapiens
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNATPPRTPEVTPLRLELQKLPGLANTTLSTPNPDTQVTIKVVEDPQAEVSIDLLAEPSNPPPQDTLSWLPALWSFLWGDYKGEEKDRAPGEKGEEKEEDEDYPSEDIEGEDQEDKEEDEEEQALWFNGTTDNWDQGWLAPGDWVFKDSVSYDYEPQKEWSPWSPCSGNCSTGKQQRTRPCGYGCTATETRTCDLPSCPGTEDKDTLGLPSEEWKLLARNATDMHDQDVDSCEKWLNCKSDFLIKYLSQMLRDLPSCPCAYPLEAMDSPVSLQDEHQGRSFRWRDASGPRERLDIYQPTARFCLRSMLSGESSTLAAQHCCYDEDSRLLTRGKGAGMPNLISTDFSPKLHFKFDTTPWILCKGDWSRLHAVLPPNNGRACTDNPLEEEYLAQLQEAKEY

SEQ ID NO: 50462 - protein, 490 aa, Homo sapiens
MRALRDRAGLLLCVLLLAALLEAALGLPVKKPRLRGPRPGSLTRLAEASASPDPRPLREEEEARLLPRTHLQAELHQHGCWTVTEPAALTPGNATPPRTQEVTPLLLELQKLPELVHATLSTPNPDNQVTIKVVEDPQAEVSIDLLAEPSNPPPQDTLSWLPALWSFLWGDYKGEEKDRAPGEKGEEKEEDEDYPSEDIEGEDQEDKEEDEEEQALWFNGTTDNWDQGWLAPGDWVFKDSVSYDYEPQKEWSPWSPCSGNCSTGKQQRTRPCGYGCTATETRTCDLPSCPGTEDKDTLGLPSEEWKLLARNATDMHDQDVDSCEKWLNCKSDFLIKYLSQMLRDLPSCPCAYPLEAMDSPVSLQDEHQGRSFRWRDASGPRERLDIYQPTARFCLRSMLSGESSTLAAQHCCYDEDSRLLTRGKGAGMPNLISTDFSPKLHFKFDTTPWILCKGDWSRLHAVLPPNNGRACTDNPLEEEYLAQLQEAKEY

SEQ ID NO: 50463 - protein, 292 aa, Homo sapiens
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNATPPRTPEVTPLRLELQKLPGLANTTLSTPNPDTQASASPDPRPLREEEEARLLPRTHLQAELHQHGCWTVTEPAALTPGNATPPRTQEVTPLLLELQKLPELVHATLSTPNPDNQTMSLRRSGVPGLPAVGTAALASSRGLGPVAMAALPPRPVPVTCPPVLALRTRTPWASPVRSGSSWPAMLRTCMIKMWTAVRSG

SEQ ID NO: 50464 - protein, 307 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKERQVRWLMPVIPALWEAEAGGSQALPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGY

SEQ ID NO: 50465 - protein, 285 aa, Homo sapiens
MARNAEKAMTALARFRQAQLEEGKVKERRPFLASECTELPKAEKWRRQIIGEISKKVAQIQNAGLGEFRIRDLNDEINKLLREKGHWEVRIKELGGPDYGKVGPKMLDHEGKEVPGNRGYKYFGAAKDLPGVRELFEKEPLPPPRKTRAELMKAIDFEYYGYLDEDDGVIVPLEQEYEKKLRAELVEKWKAEREARLARGEKEEEEEEEEEINIYAVTEEESDEEGSQEKGGDDSQQKFIAHVPVPSQQEIEEALVRRKKMELLQKYASETLQAQSEEARRLLGY

SEQ ID NO: 50466 - protein, 903 aa, Homo sapiens
MSDSGSQLGSMGSLTMKSQLQITVISAKLKENKKNWFGPSPYVEVTVDGQSKKTEKCNNTNSPKWKQPLTVIVTPVSKLHFRVWSHQTLKSDVLLGTAALDIYETLKSNNMKLEEVVVTLQLGGDKEPTETIGDLSICLDGLQLESEVVTNGETTCSENGVSLCLPRLECNSAISAHCNLCLPGLSDSPISASRVAGFTGASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 50467 - protein, 862 aa, Homo sapiens
MSDSGSQLGSMGSLTMKSQLQITVISAKLKENKKNWFGPSPYVEVTVDGQSKKTEKCNNTNSPKWKQPLTVIVTPVSKLHFRVWSHQTLKSDVLLGTAALDIYETLKSNNMKLEEVVVTLQLGGDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 50468 - protein, 752 aa, Homo sapiens
MKLEEVVVTLQLGGDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 50469 - protein, 1238 aa, Homo sapiens
MRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDANECEGKPCLNAFSCKNLIGGYYCDCIPGWKGINCHINVNDCRGQCQHGGTCKDLVNGYQCVCPRGFGGRHCELERDECASSPCHSGGLCEDLADGFHCHCPQGFSGPLCEVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 50470 - protein, 1200 aa, Homo sapiens
MRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDVNDCRGQCQHGGTCKDLVNGYQCVCPRGFGGRHCELERDECASSPCHSGGLCEDLADGFHCHCPQGFSGPLCEVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 50471 - protein, 1154 aa, Homo sapiens
MQYLNIKEDCNAMAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKTICDSSVSTHDLKVKYLATLETLTKHYGAEIFETSMLLISSENEMNWFHSNDGGNVLYYEVMVTGNLGIQWRHKPNVVSVEKEKNKLKRKKLENKHKKDEEKNKIREEWNNFSYFPEITHIVIKESVVSINKQDNKKMELKLSSHEEALSFVSLVDGYFRLTADAHHYLCTDVAPPLIVHNIQNGCHGPICTEYAINKLRQEGSEEGMYVLRWSCTDFDNILMTVTCFEKSEQVQGAQKQFKNFQIEVQKGRYSLHGSDRSFPSLGDLMSHLKKQILRTDNISFMLKRCCQPKPREISNLLVATKKAQEWQPVYPMSQLSFDRILKKDLVQGEHLGRGTRTHIYSGTLMDYKDDEGTSEEKKIKVILKVLDPSHRDISLAFFEAASMMRQVSHKHIVYLYGVCVRDVENIMVEEFVEGGPLDLFMHRKSDVLTTPWKFKVAKQLASALSYLEDKDLVHGNVCTKNLLLAREGIDSECGPFIKLSDPGIPITVLSRQECIERIPWIAPECVEDSKNLSVAADKWSFGTTLWEICYNGEIPLKDKTLIEKERFYESRCRPVTPSCKELADLMTRCMNYDPNQRPFFRAIMRDINKLEEQNPDIVSEKKPATEVDPTHFEKRFLKRIRDLGEGHFGKVELCRYDPEGDNTGEQVAVKSLKPESGGNHIADLKKEIEILRNLYHENIVKYKGICTEDGGNGIKLIMEFLPSGSLKEYLPKNKNKINLKQQLKYAVQICKGMDYLGSRQYVHRDLAARNVLVESEHQVKIGDFGLTKAIETDKEYYTVKDDRDSPVFWYAPECLMQSKFYIASDVWSFGVTLHELLTYCDSDSSPMALFLKMIGPTHGQMTVTRLVNTLKEGKRLPCPPNCPDEVYQLMRKCWEFQPSNRTSFQNLIEGFEALLK

SEQ ID NO: 50472 - protein, 619 aa, Homo sapiens
MAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSESPPPTHPTPASPKSRLFFPPLF

SEQ ID NO: 50473 - protein, 1124 aa, Homo sapiens
MAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLGDNTGALVAVKQLQHSGPDQQRDFQREIQILKALHSDFIVKYRGVSYGPGRQSLRLVMEYLPSGCLRDFLQRHRARLDASRLLLYSSQICKGMEYLGSRRCVHRDLAARNILVESEAHVKIADFGLAKLLPLDKDYYVVREPGQSPIFWYAPESLSDNIFSRQSDVWSFGVVLYELFTYCDKSCSPSAEFLRMMGCERDVPALCRLLELLEEGQRLPAPPACPAEVHELMKLCWAPSPQDRPSFSALGPQLDMLWSGSRGCETHAFTAHPEGKHHSLSFS

SEQ ID NO: 50474 - protein, 1124 aa, Homo sapiens; identical to SEQ ID NO: 50473

SEQ ID NO: 50475 - protein, 1094 aa, Homo sapiens
MAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLGDNTGALVAVKQLQHSGPDQQRDFQREIQILKALHSDFIVKYRGVSYGPGRQSLRLVMEYLPSGCLRDFLQRHRARLDASRLLLYSSQICKGMEYLGSRRCVHRDLAARNILVESEAHVKIADFGLAKLLPLDKDYYVVREPGQSPIFWYAPESLSDNIFSRQSDVWSFGVVLYELFTYCDKSCSPSAEFLRMMGCERDVPALCRLLELLEEGQRLPAPPACPAEVSAAGLASVSQSVDWAGVSGKPAGA

SEQ ID NO: 50476 - protein, 524 aa, Homo sapiens
MSGKRKRVVLTIKDKLDIIKKLEDGGSSKQLAVIYGIGETTVRDIRKNKEKIITYASSSDSTSLLAKRKSMKPSMYEELDRAMLEWFNQQRAKGNPISGPICAKRAEFFFYALGMDGDFNPSAGWLTRFKQRHSIREINIRNERLNGDETAVEDFCNNFRDFIERENLQPEQIYNADETGLFWKCLPSRISVIKGKCTVPGHKSIEERVTIMCCANATGLHKLKLCVVGKAKKPRSFKSTDTLNLPVSYFSQKGAWMDLSIFRQWFDKIFVPQVREYLRSKGLQEKAVLLLDNSPTHPNENVLRSDDGQIFAKYLPPNVASLIQPSDQGVIATMKRNYRAGLLQNNLEEGNDLKSFWKKLTLLDALYEIAMAWNLVKPVTISRAWKKILPMVEEKESLDFDVEDISVATVAAILQHTKGLENVTTENLEKWLEVDSTEPGYEVLTDSEIIRRAQGQADESSENEEEEIELIPEKHINHAAALQWTENLLDYLEQQGDMILPDRLVIRKLRATIRNKQKMTKSSQ

SEQ ID NO: 50477 - protein, 524 aa, Homo sapiens; identical to SEQ ID NO: 50476

SEQ ID NO: 50478 - protein, 416 aa, Homo sapiens
MAGDTHCPAEPLAREGTLWEALRALLPHSKEDLKLDLGEKVERSVVTLLQRATELFYEGRRDECLQSSEVILDYSWEKLNTGTWQDVDKDWRRVYAIGCLLKALCLCQAPEDANTVAAALRVCDMGLLMGAAILGDILLKVAAILQTHLPGKRPARGSLPEQPCTKKARADHGLIPDVKLEKTVPRLHRPSLQHFREQFLVPGRPVILKGVADHWPCMQKWSLEYIQEIAGCRTVPVEVGSRYTDEEWSQTLMTVNEFISKYIVNEPRDVGYLAQHQLFDQIPELKQDISIPDYCSLGDGEEEEITINAWFGPQGTISPLHQDPQQNFLVQVMGRKYIRLYSPQESGALYPHDTHLLHNTSQVDVENPDLEKFPKFAKAPFLSCILSPGEILFIPVKYWHYVRALDLSFSVSFWWS

SEQ ID NO: 50479 - protein, 220 aa, Homo sapiens
MAGDTHCPAEPLAREGTLWEALRALLPHSKEDLKLDLGEKVERSVVTLLQRATELFYEGRRDECLQSSEVILDYSWEKLNTGTWQDVDKDWRRVYAIGCLLKALCLCQAPEDANTVAAALRVCDMGLLMGAAILGDILLKVAAILQTHLPGKRPARGSLPEQPCTKVDVENPDLEKFPKFAKAPFLSCILSPGEILFIPVKYWHYVRALDLSFSVSFWWS

SEQ ID NO: 50480 - protein, 454 aa, Homo sapiens
MSREKCSPGEGAEEGRGSEASGLKASAGHGTEPAGGGPMAGDTHCPAEPLAREGTLWEALRALLPHSKEDLKLDLGEKVERSVVTLLQRATELFYEGRRDECLQSSEVILDYSWEKLNTGTWQDVDKDWRRVYAIGCLLKALCLCQAPEDANTVAAALRVCDMGLLMGAAILGDILLKVAAILQTHLPGKRPARGSLPEQPCTKKARADHGLIPDVKLEKTVPRLHRPSLQHFREQFLVPGRPVILKGVADHWPCMQKWSLEYIQEIAGCRTVPVEVGSRYTDEEWSQTLMTVNEFISKYIVNEPRDVGYLAQHQLFDQIPELKQDISIPDYCSLGDGEEEEITINAWFGPQGTISPLHQDPQQNFLVQVMGRKYIRLYSPQESGALYPHDTHLLHNTSQVDVENPDLEKFPKFAKAPFLSCILSPGEILFIPVKYWHYVRALDLSFSVSFWWS

SEQ ID NO: 50481 - protein, 146 aa, Homo sapiens
MTVNEFISKYIVNEPRDVGYLAQHQLFDQIPELKQDISIPDYCSLGDGEEEEITINAWFGPQGTISPLHQDPQQNFLVQVMGRKYIRLYSPQESGALYPHDTHLLHNTSQVDVENPDLEKFPKFAKAPFLSCILSPGEILFIPVKY

SEQ ID NO: 50482 - protein, 372 aa, Homo sapiens
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYRILKQEHPELAVLADSVDLQESTGIASDSSSDSSSSSSSSSSDSDSERIRDTCGGRAHP

SEQ ID NO: 50483 - protein, 403 aa, Homo sapiens
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYRILKQEHPELAVLADSVDLQESTGIASDSSSDSSSSSSSSSSDSDSECESGSEGDGTVHRRKKRRTCSMVGNGDTTSQDDCVSKERSSSR

SEQ ID NO: 50484 - protein, 414 aa, Homo sapiens
MNHKSKKRIREAKRSARPELKDSLDWTRHNYYESFSLSPAAVADNVERADALQLSVEEFVERYERPYKPVVLLNAQEGWSAQEKWTLERLKRKYRNQKFKCGEDNDGYSVKMKMKYYIEYMESTRDDSPLYIFDSSYGEHPKRRKLLEDYKVPKFFTDDLFQYAGEKRRPPYRWFVMGPPRSGTGIHIDPLGTSAWNALVQGHKRWCLFPTSTPRELIKVTRDEGGNQQDEAITWFNVIYPRTQLPTWPPEFKPLEILQKPGETVFVPGGWWHVVLNLDTTIAITQNFASSTNFPVVWHKTVRGRPKLSRKWYRILKQEHPELAVLADSVDLQESTGIASDSSSDSSSSSSSSSSDSDSECESGSEGDGTVHRRKKRRTCSMVGNGDTTSQDDCVSKERSSSRIRDTCGGRAHP

SEQ ID NO: 50485 - protein, 146 aa, Homo sapiens
MLAGAGRPGLPQGRHLCWLLCAFTLKLCQAEAPVQEEKLSASTSNLPCWLVEEFVVAEECSPCSNFRAKTTPECGPTGYVEKITCSSSKRNEFKSCRSALMEQRLFWKFEGAVVCVALIFACLVIIRQRQLDRKALEKVRKQIESI

SEQ ID NO: 50486 - protein, 117 aa, Homo sapiens
MAWGWHLSFLSASTSNLPCWLVEEFVVAEECSPCSNFRAKTTPECGPTGYVEKITCSSSKRNEFKSCRSALMEQRLFWKFEGAVVCVALIFACLVIIRQRQLDRKALEKVRKQIESI

SEQ ID NO: 50487 - protein, 117 aa, Homo sapiens; identical to SEQ ID NO: 50486

SEQ ID NO: 50488 - protein, 117 aa, Homo sapiens; identical to SEQ ID NO: 50486

SEQ ID NO: 50489 - protein, 347 aa, Homo sapiens
METPFYGDEALSGLGGGASGSGGSFASPGRLFPGAPPTAAAGSMMKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 50490 - protein, 977 aa, Homo sapiens
MSFALEETLESDWVAVRPHVFDEREKHKFVFIVAWNEIEGKFAITCHNRTAQRQRSGSREQAGARGGAEAGGAASDGSRGPGSPAGRGRPEATASATLVRSPGPRRSSAWAEGGSPRSTRSLLGDPRLRSPGSKGAESRLRSPVRAKPIPGQKTSEADDAAGAAAAAARPAPREAQVSSVRIVSASGTVSEEIEVLEMVKEDEAPLALSDAEQPPPATELESPAEECSWAGLFSFQDLRAVHQQLCSVNSQLEPCLPVFPEEPSGMWTVLFGGAPEMTEQEIDTLCYQLQVYLGHGLDTCGWKILSQVLFTETDDPEEYYESLSELRQKGYEEVLQRARKRIQELLDKHKNTESMVELLDLYQMEDEAYSSLAEATTELYQYLLQPFRDMRELAMLRRQQIKISMENDYLGPRRIESLQKEDADWQRKAHMAVLSIQDLTVKYFEITAKAQKAVYDRMRADQKKFGKASWAAAAERMEKLQYAVSKETLQMMRAKEICLEQRKHALKEEMQSLRGGTEAIARLDQLEADYYDLQLQLYEVQFEILKCEELLLTAQLESIKRLISEKRDEVVYYDTYESMEAMLEKEEMAASAYLQREELQKLQQKARQLEARRGRVSAKKSYLRNKKEICIAKHNEKIQQRTRIEDEYRTHHTVQLKREKLHDEEERKSAWVSQERQRTLDRLRTFKQRYPGQVILKSTRLRLAHARRKGAASPVLQEDHCDSLPSVLQVEEKTEEVGEGRVKRGPSQTTEPQSLVQLEDTSLTQLEATSLPLSGVTSELPPTISLPLLNNNLEPCSVTINPLPSPLPPTPPPPLPVAKDSGPETLEKDLPRKEGNEKRIPKSASAPSAHLFDSSQLVSARKKLRKTAEGLQRRRVSSPMDEVLASLKRGSFHLKKVEQRTLPPFPDEDDSNNILAQIRKGVKLKKVQKDVLRESFTLLPDTDPLTRSIHEALRRIKEASPESEDEEEALPCTDWEN

SEQ ID NO: 50491 - protein, 988 aa, Homo sapiens
MSFALEETLESDWVAVRPHVFDEREKHKFVFIVAWNEIEGKFAITCHNRTAQRQRSGSREQAGARGGAEAGGAASDGSRGPGSPAGRGRPEATASATLVRSPGPRRSSAWAEGGSPRSTRSLLGDPRLRSPGSKGAESRLRSPVRAKPIPGQKTSEADDAAGAAAAAARPAPREAQVSSVRIVSASGTVSEEIEVLEMVKEDEAPLALSDAEQPPPATELESPAEECSWAGLFSFQDLRAVHQQLCSVNSQLEPCLPVFPEEPSGMWTVLFGGAPEMTEQEIDTLCYQLQVYLGHGLDTCGWKILSQVLFTETDDPEEYYESLSELRQKGYEEVLQRARKRIQELLDKHKNTESMVELLDLYQMEDEAYSSLAEATTELYQYLLQPFRDMRELAMLRRQQIKISMENDYLGPRRIESLQKEDADWQRKAHMAVLSIQDLTVKYFEITAKAQKAVYDRMRADQKKFGKASWAAAAERMEKLQYAVSKETLQMMRAKEICLEQRKHALKEEMQSLRGGTEAIARLDQLEADYYDLQLQLYEVQFEILKCEELLLTAQLESIKRLISEKRDEVVYYDTYESMEAMLEKEEMAASAYLQREELQKLQQKARQLEARRGRVSAKKSYLRNKKEICIAKHNEKIQQRTRIEDEYRTHHTVQLKREKLHDEEERKSAWVSQERQRTLDRLRTFKQRYPGQVILKSTRLRLAHARRKGAASPVLQEDHCDSLPSVLQVEEKTEEVGEGRVKRGPSQTTEPQSLVQLEDTSLTQLEATSLPLSGVTSELPPTISLPLLNNNLEPCSVTINPLPSPLPPTPPPPPPPPPPPPPPPLPVAKDSGPETLEKDLPRKEGNEKRIPKSASAPSAHLFDSSQLVSARKKLRKTAEGLQRRRVSSPMDEVLASLKRGSFHLKKVEQRTLPPFPDEDDSNNILAQIRKGVKLKKVQKDVLRESFTLLPDTDPLTRSIHEALRRIKEASPESEDEEEALPCTDWEN

SEQ ID NO: 50492 - protein, 745 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 50493 - protein, 745 aa, Homo sapiens; identical to SEQ ID NO: 50492

SEQ ID NO: 50494 - protein, 745 aa, Homo sapiens; identical to SEQ ID NO: 50492

SEQ ID NO: 50495 - protein, 277 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLL

SEQ ID NO: 50496 - protein, 235 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRML

SEQ ID NO: 50497 - protein, 296 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLA

SEQ ID NO: 50498 - protein, 86 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVR

SEQ ID NO: 50499 - protein, 298 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYG

SEQ ID NO: 50500 - protein, 591 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKILTATVDNANILLQIDNARLAADDFRTKFETEQALRLSVEADINGLRRVLDELTLARADLEMQIENLKEELAYLKKNHEEEMNALRGQVGGEINVEMDAAPGVDLSRILNEMRDQYEKMAEKNRKDAEDWFFSKTEELNREVATNSELVQSGKSEISELRRTMQALEIELQSQLSMKASLEGNLAETENRYCVQLSQIQGLIGSVEEQLAQLRCEMEQQNQEYKILLDVKTRLEQEIATYRRLLEGEDAHLTQYKKEPVTTRQVRTIVEEVQDGKVISSREQVHQTTR

SEQ ID NO: 50501 - protein, 298 aa, Homo sapiens
MARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSSKYMFMKSNSSSKATTMSENDFKHTKSFII

SEQ ID NO: 50502 - protein, 262 aa, Homo sapiens
MARRSRHRLLLLLLRYLVVALGYHKAYGFSAPKDQQVVTAVEYQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 50503 - protein, 298 aa, Homo sapiens
MARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 50504 - protein, 312 aa, Homo sapiens
MARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENVQWLTPVIPALWKAAAGGSRGQEF

SEQ ID NO: 50505 - protein, 310 aa, Homo sapiens
MALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 50506 - protein, 259 aa, Homo sapiens
MALRRPPRLRLCARLPDFFLLLLFRGCLIGAVNLKSSNRTPVVQEFESVELSCIITDSQTSDPRIEWKKIQDEQTTYVFFDNKIQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 50507 - protein, 355 aa, Homo sapiens
MVPARLGPAVAMVTGAGRRVLAGWAHARGDYKPRRAAAGPSATLDMALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 50508 - protein, 661 aa, Homo sapiens
MTGGRFDFDDGGTYCGGWEEGKAHGHGICTGPKGQGEYSGSWSHGFEVVGGYTWPSGNTYQGYWAQGKRHGLGVETKGKWMYRGEWSHGFKGRYGVRQSLCTPARYEGTWSNGLQDGYGVETYGDGGTYQGQWAGGMRHGYGVRQSVPYGMATVIRSPLRTSLASLRSEQSNGSVLHDAAAAADSPAGTRGGFVLNFHADAELAGKKKGGLFRRGSLLGSMKLRKSESKSSISSKRSSVRSDAAMSRISSSDANSTISFGDVDCDFCPVEDHVDATTTETYMGEWKNDKRNGFGVSERSNGMKYEGEWANNKRHGYGCTVFPDGSKEEGKYKNNILVRGIRKQLIPIRHTKTREKVDRAIEGAQRAAAMARTKVEIANSRTAHARAKADAADQAALAARQECDIARAVARELSPDFYQPGPDYVKQRFQEGVDAKENPEEKVPEKPPTPKESPHFYRKGTTPPRSPEASPKHSHSPASSPKPLKKQNPSSGARLNQDKRSVADEQVTAIVNKPLMSKAPTKEAGAVVPQSKYSGRHHIPNPSNGELHSQYHGYYVKLNAPQHPPVDVEDGDGSSQSSSALVHKPSANKWSPSKSVTKPVAKESKAEPKAKKSELAIPKNPASNDSCPALEKEANSGPNSIMIVLVMLLNIGLAILFVHFLT

SEQ ID NO: 50509 - protein, 129 aa, Homo sapiens
MSGGRFDFDDGGAYCGGWEGGKAHGHGLCTGPKGQGEYSGSWNFGFEVAGVYTWPSGNTFEGYWSQGKRHGLGIETKGRWLYKGEWTHGFKGRYGIRQSSSSGAKYEGTWNNGLQDGYGTETYADGGMC

SEQ ID NO: 50510 - protein, 696 aa, Homo sapiens
MSGGRFDFDDGGAYCGGWEGGKAHGHGLCTGPKGQGEYSGSWNFGFEVAGVYTWPSGNTFEGYWSQGKRHGLGIETKGRWLYKGEWTHGFKGRYGIRQSSSSGAKYEGTWNNGLQDGYGTETYADGGTYQGQFTNGMRHGYGVRQSVPYGMAVVVRSPLRTSLSSLRSEHSNGTVAPDSPASPASDGPALPSPAIPRGGFALSLLANAEAAARAPKGGGLFQRGALLGKLRRAESRTSVGSQRSRVSFLKSDLSSGASDAASTASLGEAAEGADEAAPFEADIDATTTETYMGEWKNDKRSGFGVSERSSGLRYEGEWLDNLRHGYGCTTLPDGHREEGKYRHNVLVKDTKRRMLQLKSNKVRQKVEHSVEGAQRAAAIARQKAEIAASRTSHAKAKAEAAEQAALAANQESNIARTLARELAPDFYQPGPEYQKRRLLQEILENSESLLEPPDRGAGAAGLPQPPRESPQLHERETPRPEGGSPSPAGTPPQPKRPRPGVSKDGLLSPGAWNGEPSGEGSRSVTPSEGAGRRSPARPATERMAIEALQAPPAPSREPEVALYQGYHSYAVRTTPPEPPPFEDQPEPEVSGSESAPSSPATAPLQAPTLRGPEPARETPAKLEPKPIIPKAEPRAKARKTEARGLTKAGAKKKARKEAALAAEAEVEVEEVPNTILICMVILLNIGLAILFVHLLT

SEQ ID NO: 50511 - protein, 748 aa, Homo sapiens
MSSGGRFNFDDGGSYCGGWEDGKAHGHGVCTGPKGQGEYTGSWSHGFEVLGVYTWPSGNTYQGTWAQGKRHGIGLESKGKWVYKGEWTHGFKGRYGVRECAGNGAKYEGTWSNGLQDGYGTETYSDGGTYQGQWVGGMRQGYGVRQSVPYGMAAVIRSPLRTSINSLRSEHTNGTALHPDASPAVAGSPAVSRGGFVLVAHSDSEILKSKKKGLFRRSLLSGLKLRKSESKSSLASQRSKQSSFRSEAGMSTVSSTASDIHSTISLGEAEAELAVIEDDIDATTTETYVGEWKNDKRSGFGVSQRSDGLKYEGEWASNRRHGYGCMTFPDGTKEEGKYKQNILVGGKRKNLIPLRASKIREKVDRAVEAAERAATIAKQKAEIAASRTSHSRAKAEAALTAAQKAQEEARIARITAKEFSPSFQHRENGLEYQRPKRQTSCDDIEVLSTGTPLQQESPELYRKGTTPSDLTPDDSPLQSFPTSPAATPPPAPAARNKVAHFSRQVSVDEERGGDIQMLLEGRAGDCARSSWGEEQAGGSRGVRSGALRGGLLVDDFRTRGSGRKQPGNPKPRERRTESPPVFTWTSHHRASNHSPGGSRLLELQEEKLSNYRMEMKPLLRMETHPQKRRYSKGGACRGLGDDHRPEDRGFGVQRLRSKAQNKENFRPASSAEPAVQKLASLRLGGAEPRLLRWDLTFSPPQKSLPVALESDEENGDELKSSTGSAPILVVMVILLNIGVAILFINFFI

SEQ ID NO: 50512 - protein, 186 aa, Homo sapiens
MSSGGRFNFDDGGSYCGGWEDGKAHGHGVCTGPKGQGEYTGSWSHGFEVLGVYTWPSGNTYQGTWAQGKRHGIGLESKGKWVYKGEWTHGFKGRYGVRECAGNGAKYEGTWSNGLQDGYGTETYSDGDATAFGAEPGPEARELPAAAAAAAAAAAAAVRWFLCREPWPALQLPACLDSPISTPQCT

SEQ ID NO: 50513 - protein, 31 aa, Homo sapiens
MPPHSGQSRGRKPGSCLLLLLLLLLLLLLLL

SEQ ID NO: 50514 - protein, 611 aa, Homo sapiens
MRQGYGVRQSVPYGMAAVIRSPLRTSINSLRSEHTNGTALHPDASPAVAGSPAVSRGGFVLVAHSDSEILKSKKKGLFRRSLLSGLKLRKSESKSSLASQRSKQSSFRSEAGMSTVSSTASDIHSTISLGEAEAELAVIEDDIDATTTETYVGEWKNDKRSGFGVSQRSDGLKYEGEWASNRRHGYGCMTFPDGTKEEGKYKQNILVGGKRKNLIPLRASKIREKVDRAVEAAERAATIAKQKAEIAASRTSHSRAKAEAALTAAQKAQEEARIARITAKEFSPSFQHRENGLEYQRPKRQTSCDDIEVLSTGTPLQQESPELYRKGTTPSDLTPDDSPLQSFPTSPAATPPPAPAARNKVAHFSRQVSVDEERGGDIQMLLEGRAGDCARSSWGEEQAGGSRGVRSGALRGGLLVDDFRTRGSGRKQPGNPKPRERRTESPPVFTWTSHHRASNHSPGGSRLLELQEEKLSNYRMEMKPLLRMETHPQKRRYSKGGACRGLGDDHRPEDRGFGVQRLRSKAQNKENFRPASSAEPAVQKLASLRLGGAEPRLLRWDLTFSPPQKSLPVALESDEENGDELKSSTGSAPILVVMVILLNIGVAILFINFFI

SEQ ID NO: 50515 - protein, 837 aa, Homo sapiens
MAEPSQAPTPAPAAQPRPLQSPAPAPTPTPAPSPASAPIPTPTPAPAPAPAAAPAGSTGTGGPGVGSGGAGSGGDPARPGLSQQQRASQRKAQVRGLPRAKKLEKLGVFSACKANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFPKFLSMLEEEIYGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPKHKTLALIKDGRVIGGICFRMFPTQGFTEIVFCAVTSNEQVKGYGTHLMNHLKEYHIKHNILYFLTYADEYAIGYFKKQGFSKDIKVPKSRYLGYIKDYEGATLMECELNPRIPYTELSHIIKKQKEIIKKLIERKQAQIRKVYPGLSCFKEGVRQIPVESVPGIRETGWKPLGKEKGKELKDPDQLYTTLKNLLAQIKSHPSAWPFMEPVKKSEAPDYYEVIRFPIDLKTMTERLRSRYYVTRKLFVADLQRVIANCREYNPPDSEYCRCASALEKFFYFKLKEGGLIDK

SEQ ID NO: 50516 - protein, 546 aa, Homo sapiens
MAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 50517 - protein, 461 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 50518 - protein, 513 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 50519 - protein, 494 aa, Homo sapiens
MAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 50520 - protein, 2073 aa, Homo sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATGTTQKLKPPPSSLPPPTPISGQSPSSQKSSTATSSPSPQSSSSQCSVPSLSSLTTNSQLKALFDGLSHIYTTQGQSRKKGHPSYAPPKRMRRKTELSSTAKSKAHFFGKRDIRSRFISHSSSSSWGMARGSIFKAIAHFKRTTFLKKHRMLGRLKYKVTPQMGTPSPGKGSLTDGRIKPDQDDDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYFSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 50521 - protein, 1890 aa, Homo sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYFSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 50522 - protein, 1781 aa, Homo sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYFSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 50523 - protein, 1781 aa, Homo sapiens; identical to SEQ ID NO: 50522

SEQ ID NO: 50524 - protein, 1781 aa, Homo sapiens; identical to SEQ ID NO: 50522

SEQ ID NO: 50525 - protein, 1663 aa, Homo sapiens
MTDRFWDQWYLWYLRLLRLLDRGSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKDGNLVPRWHLGPGDPFSTYV

SEQ ID NO: 50526 - protein, 1289 aa, Homo sapiens
MKGGDRAYTRGPSLGWLFAKCCCCFPCRDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSSSLLAARQASTEVPTAADLVNAIEKLVKNKLSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKQNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 50527 - protein, 2986 aa, Homo sapiens
MTDRFWDQWYLWYLRLLRLLDRGSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKLSGGCELTVVLQDFSAGHSSELTIQVGQTVELLERPSERPGWCLVRTTERSPPLEGLVPSSALCISHSRSSVEMDCFFPLVKDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSSSLLAARQASTEVPTAADLVNAIEKLVKNKLSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKQNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 50528 - protein, 1257 aa, Homo sapiens
MKGGDRAYTRGPSLGWLFAKCCCCFPCRDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKQNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 50529 - protein, 1654 aa, Homo sapiens
MTDRFWDQWYLWYLRLLRLLDRGSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIEKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKDGNLVPRWHLGPGDPFSTYV

SEQ ID NO: 50530 - protein, 262 aa, Homo sapiens
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 50531 - protein, 160 aa, Homo sapiens
MSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 50532 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 50533 - protein, 514 aa, Homo sapiens
MYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGRFRWSLSLQTQWNVAFGGHHQLG

SEQ ID NO: 50534 - protein, 148 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQ

SEQ ID NO: 50535 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 50536 - protein, 282 aa, Homo sapiens
MQRLRWLRDWKSSGRGLTAAKEPGARSSPLQAMRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 50537 - protein, 275 aa, Homo sapiens
MRILQLILLALATGLVGGETRIIKGFECKPHSQPWQAALFEKTRLLCGATLIAPRWLLTAAHCLKPWVSLTSPTHVSPDLSSSNYCLSHLSRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 50538 - protein, 250 aa, Homo sapiens; identical to SEQ ID NO: 50535

SEQ ID NO: 50539 - protein, 282 aa, Homo sapiens; identical to SEQ ID NO: 50536

SEQ ID NO: 50540 - protein, 254 aa, Homo sapiens
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICNSTLVGLGTSWNFNSCQPF

SEQ ID NO: 50541 - protein, 144 aa, Homo sapiens
MALSVGVTHSRGRWGCLRAPACAAGVSLLTTGGSSQRLTAAADPFPDLLQCLNLSIVSHATCHGVYPGRITSNMVCAGGVPGQDACQGDSGGPLVCGGVLQGLVSWGSVGPCGQDGIPGVYTYICNSTLVGLGTSWNFNSCQPF

SEQ ID NO: 50542 - protein, 248 aa, Homo sapiens
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICKYVDWIRMIMRNN

SEQ ID NO: 50543 - protein, 248 aa, Homo sapiens; identical to SEQ ID NO: 50542

SEQ ID NO: 50544 - protein, 111 aa, Homo sapiens
MGLSIFLLLCVLGLSQAATPKIFNGTECGRNSQPWQVGLFEGTSLRCGGVLIDHRWVLTAAHCSGRPIPGSAPVPQPLHRLPCHLPWCVSRENHEQHGVCRRRPGAGCLPG

SEQ ID NO: 50545 - protein, 277 aa, Homo sapiens
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 50546 - protein, 125 aa, Homo sapiens
MWPLALVIASLTLALSGVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 50547 - protein, 98 aa, Homo sapiens
MGLIYKCLPEKVTVNIETRCLPGVFQGSQHQWDQWVSPRWLHLLPPLSALAGCPTSARAATLWGSPGPPQMGPHCRTLSKGGAQSLPRQARPRACGSW

SEQ ID NO: 50548 - protein, 93 aa, Homo sapiens
MWPLALVIASLTLALSGGEDFKEPSQGPRDVMAASRPEAFPKGLTLEPRPEKGGICGCLAPGTILGLKVGWLFSSGDTPWIHARATPECHTLG

SEQ ID NO: 50549 - protein, 277 aa, Homo sapiens; identical to SEQ ID NO: 50545

SEQ ID NO: 50550 - protein, 267 aa, Homo sapiens
MSLRVLGSGTWPSAPKMFLLLTALQVLAIAMTQSQEDENKIIGGHTCTRSSQPWQAALLAGPRRRFLCGGALLSGQWVITAAHCGRPILQVALGKHNLRRWEATQQVLRVVRQVTHPNYNSRTHDNDLMLLQLQQPARIGRAVRPIEVTQACASPGTSCRVSGWGTISSPIARYPASLQCVNINISPDEVCQKAYPRTITPGMVCAGVPQGGKDSCQGDSGGPLVCRGQLQGLVSWGMERCALPGYPGVYTNLCKYRSWIEETMRDK

SEQ ID NO: 50551 - protein, 267 aa, Homo sapiens; identical to SEQ ID NO: 50550

SEQ ID NO: 50552 - protein, 267 aa, Homo sapiens; identical to SEQ ID NO: 50550

SEQ ID NO: 50553 - protein, 161 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQG

SEQ ID NO: 50554 - protein, 256 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQVSLPDTLHCANISIISDTSCDKSYPGRLTNTMVCAGAEGRGAESCEGDSGGPLVCGGILQGIVSWGDVPCDNTTKPGVYTKVCHYLEWIRETMKRN

SEQ ID NO: 50555 - protein, 171 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQGDSGGPLVCGGILQGIVSWGDVPCDNTTKPGVYTKVCHYLEWIRETMKRN

SEQ ID NO: 50556 - protein, 162 aa, Homo sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQGA

SEQ ID NO: 50557 - protein, 256 aa, Homo sapiens; identical to SEQ ID NO: 50554

SEQ ID NO: 50558 - protein, 261 aa, Homo sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 50559 - protein, 223 aa, Homo sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKG

SEQ ID NO: 50560 - protein, 159 aa, Homo sapiens
MSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 50561 - protein, 261 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 50562 - protein, 220 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 50563 - protein, 238 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSWVILITELTMPALPMVLHGSLVPWRGGV

SEQ ID NO: 50564 - protein, 218 aa, Homo sapiens
MWVPVVFLTLSVTWIGAAPLILSRIVGGWECEKHSQPWQVLVASRGRAVCGGVLVHPQWVLTAAHCIRKPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 50565 - protein, 69 aa, Homo sapiens
MWVPVVFLTLSVTWIGAAPLILSRIVGGWECEKHSQPWQVLVASRGRAVCGGVLVHPQWVLTAAHCIRK

SEQ ID NO: 50566 - protein, 254 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGHDQKDSCNGDSGGPLICNGYLQGLVSFGKAPCGQVGVPGVYTNLCKFTEWIEKTVQAS

SEQ ID NO: 50567 - protein, 110 aa, Homo sapiens
MENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANG

SEQ ID NO: 50568 - protein, 244 aa, Homo sapiens
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 50569 - protein, 244 aa, Homo sapiens; identical to SEQ ID NO: 50568

SEQ ID NO: 50570 - protein, 120 aa, Homo sapiens
MKKLMVVLSLIAAAWAEEQNKLVHGGPCDKTSHPYQAALYTSGHLLCGGVLIHPLWVLTAAHCKKPVILGVRWYVETTSEALCHGVTSPVDQRRSQESTPTSADTRTGSKKPFRPSDPDM

SEQ ID NO: 50571 - protein, 137 aa, Homo sapiens
MLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 50572 - protein, 40 aa, Homo sapiens
MKKLMVVLSLIAAGIFRSSWGSITFGKGRVPRSRVLLSGL

SEQ ID NO: 50573 - protein, 137 aa, Homo sapiens; identical to SEQ ID NO: 50571

SEQ ID NO: 50574 - protein, 260 aa, Homo sapiens
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 50575 - protein, 32 aa, Homo sapiens
MGRPRPRAAKTWMFLLLLGGAWAGRFWRPPGV

SEQ ID NO: 50576 - protein, 119 aa, Homo sapiens
MGRPRPRAAKTWMFLLLLGGAWAENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 50577 - protein, 305 aa, Homo sapiens
MGRPRPRAAKTWMFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 50578 - protein, 260 aa, Homo sapiens; identical to SEQ ID NO: 50574

SEQ ID NO: 50579 - protein, 250 aa, Homo sapiens
MKLGLLCALLSLLAGHGWADTRAIGAEECRPNSQPWQAGLFHLTRLFCGATLISDRWLLTAAHCRKPYLWVRLGEHHLWKWEGPEQLFRVTDFFPHPGFNKDLSANDHNDDIMLIRLPRQARLSPAVQPLNLSQTCVSPGMQCLISGWGAVSSPKALFPVTLQCANISILENKLCHWAYPGHISDSMLCAGLWEGGRGSCQGDSGGPLVCNGTLAGVVSGGAEPCSRPRRPAVYTSVCHYLDWIQEIMEN

SEQ ID NO: 50580 - protein, 250 aa, Homo sapiens; identical to SEQ ID NO: 50579

SEQ ID NO: 50581 - protein, 61 aa, Homo sapiens
MKLGLLCALLSLLAGICGSALESTTSGNGRVRSSCSGLRTSSPTLASTRTSAPMTTMMTSC

SEQ ID NO: 50582 - protein, 680 aa, Homo sapiens
MVPGVPGAVLTLCLWLAASSGCLAAGPGAAAARRLDESLSAGSVQRARCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKGVPLKPRKELRFTELQSGQLEVKWSSKFNISIEPVIYVVQRRWNYGIHPSEDDATHWQTVAQTTDERVQLTDIRPSRWYQFRVAAVNVHGTRGFTAPSKHFRSSKDPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNKEQLVKTRKGGIQTQLPFQRRRPTRPLEVGAPFYQDGQLQVKVYWKKTEDPTVNRYHVRWFPEACAHNRTTGSEASSGMTHENYIILQDLSFSCKYKVTVQPIRPKSHSKAEAVFFTTPPCSALKGKSHKPVGCLGEAGHVLSKVLAKPENLSASFIVQDVNITGHFSWKMAKANLYQPMTGFQVTWAEVTTESRQNSLPNSIISQSQILPSDHYVLTVPNLRPSTLYRLEVQVLTPGGEGPATIKTFRTPELPPSSAHRSHLKHRHPHHYKPSPERY

SEQ ID NO: 50583 - protein, 876 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 50584 - protein, 731 aa, Homo sapiens
MKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 50585 - protein, 660 aa, Homo sapiens
MKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFADENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 50586 - protein, 731 aa, Homo sapiens; identical to SEQ ID NO: 50584

SEQ ID NO: 50587 - protein, 538 aa, Homo sapiens
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYKVVSPALRAVGNIVTGDDIQTQVILNCSALQSLLHLLSSPKESIKKEACWTISNITAGNRAQIQTVIDANIFPALISILQTAEFRTRKEAAWAITNATSGGSAEQIKYLVELGCIKPLCDLLTVMDSKIVQVALNGLENILRLGEQEAKRNGTGINPYCALIEEAYGLDKIEFLQSHENQEIYQKAFDLIEHYFGTEDEDSSIAPQVDLNQQQYIFQQCEAPMEGFQL

SEQ ID NO: 50588 - protein, 328 aa, Homo sapiens
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYKVVSPALRAVGNIVTGDD

SEQ ID NO: 50589 - protein, 215 aa, Homo sapiens
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPP

SEQ ID NO: 50590 - protein, 174 aa, Homo sapiens
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIF

SEQ ID NO: 50591 - protein, 521 aa, Homo sapiens
MAENPSLENHRIKSFKNKGRDVETMRRHRNEVTVELRKNKRDEHLLKKRNVPQEESLEDSDVDADFKAQNVTLEAILQNATSDNPVVQLSAVQAARKLLSSDRNPPIDDLIKSGILPILVKCLERDDNPSLQFEAAWALTNIASGTSAQTQAVVQSNAVPLFLRLLRSPHQNVCEQAVWALGNIIGDGPQCRDYVISLGVVKPLLSFISPSIPITFLRNVTWVIVNLCRNKDPPPPMETVQEILPALCVLIYHTDINILVDTVWALSYLTDGGNEQIQMVIDSGVVPFLVPLLSHQEVKVQTAALRAVGNIVTGTDEQTQVVLNCDVLSHFPNLLSHPKEKINKEAVWFLSNITAGNQQQVQAVIDAGLIPMIIHQLAKGDFGTQKEAAWAISNLTISGRKDQVEYLVQQNVIPPFCNLLSVKDSQVVQVVLDGLKNILIMAGDEASTIAEIIEECGGLEKIEVLQQHENEDIYKLAFEIIDQYFSGDDIDEDPCLIPEATQGGTYNFDPTANLQTKEFNF

SEQ ID NO: 50592 - protein, 521 aa, Homo sapiens
MADNEKLDNQRLKNFKNKGRDLETMRRQRNEVVVELRKNKRDEHLLKRRNVPHEDICEDSDIDGDYRVQNTSLEAIVQNASSDNQGIQLSAVQAARKLLSSDRNPPIDDLIKSGILPILVHCLERDDNPSLQFEAAWALTNIASGTSEQTQAVVQSNAVPLFLRLLHSPHQNVCEQAVWALGNIIGDGPQCRDYVISLGVVKPLLSFISPSIPITFLRNVTWVMVNLCRHKDPPPPMETIQEILPALCVLIHHTDVNILVDTVWALSYLTDAGNEQIQMVIDSGIVPHLVPLLSHQEVKVQTAALRAVGNIVTGTDEQTQVVLNCDALSHFPALLTHPKEKINKEAVWFLSNITAGNQQQVQAVIDANLVPMIIHLLDKGDFGTQKEAAWAISNLTISGRKDQVAYLIQQNVIPPFCNLLTVKDAQVVQVVLDGLSNILKMAEDEAETIGNLIEECGGLEKIEQLQNHENEDIYKLAYEIIDQFFSSDDIDEDPSLVPEAIQGGTFGFNSSANVPTEGFQF

SEQ ID NO: 50593 - protein, 516 aa, Homo sapiens
MPTLDAPEERRRKFKYRGKDVSLRRQQRMAVSLELRKAKKDEQTLKRRNITSFCPDTPSEKTAKGVAVSLTLGEIIKGVNSSDPVLCFQATQTARKMLSQEKNPPLKLVIEAGLIPRMVEFLKSSLYPCLQFEAAWALTNIASGTSEQTRAVVEGGAIQPLIELLSSSNVAVCEQAVWALGNIAGDGPEFRDNVITSNAIPHLLALISPTLPITFLRNITWTLSNLCRNKNPYPCDTAVKQILPALLHLLQHQDSEVLSDACWALSYLTDGSNKRIGQVVNTGVLPRLVVLMTSSELNVLTPSLRTVGNIVTGTDEQTQMAIDAGMLNVLPQLLQHNKPSIQKEAAWALSNVAAGPCHHIQQLLAYDVLPPLVALLKNGEFKVQKEAVWMVANFATGATMDQLIQLVHSGVLEPLVNLLTAPDVKIVLIILDVISCILQAAEKRSEKENLCLLIEELGGIDRIEALQLHENRQIGQSALNIIEKHFGEEEDESQTLLSQVIDQDYEFIDYECLAKK

SEQ ID NO: 50594 - protein, 1105 aa, Homo sapiens
MAAMAPALTDAAAEAHHIRFKLAPPSSTLSPGSAENNGNANILIAANGTKRKAIAAEDPSLDFRNNPTKEDLGKLQPLVASYLCSDVTSVPSKESLKLQGVFSKQTVLKSHPLLSQSYELRAELLGRQPVLEFSLENLRTMNTSGQTALPQAPVNGLAKKLTKSSTHSDHDNSTSLNGGKRALTSSALHGGEMGGSESGDLKGGMTNCTLPHRSLDVEHTTLYSNNSTANKSSVNSMEQPALQGSSRLSPGTDSSSNLGGVKLEGKKSPLSSILFSALDSDTRITALLRRQADIESRARRLQKRLQVVQAKQVERHIQHQLGGFLEKTLSKLPNLESLRPRSQLMLTRKAEAALRKAASETTTSEGLSNFLKSNSISEELERFTASGIANLRCSEQAFDSDVTDSSSGGESDIEEEELTRADPEQRHVPLRRRSEWKWAADRAAIVSRWNWLQAHVSDLEYRIRQQTDIYKQIRANKGLIVLGEVPPPEHTTDLFLPLSSEVKTDHGTDKLIESVSQPLENHGARIIGHISESLSTKSCGALRPVNGVINTLQPVLADHIPGDSSDAEEQLHKKQRLNLVSSSSDGTCVAARTRPVLSCKKRRLVRPNSIVPLSKKVHRNSTIRPGCDVNPSCALCGSGSINTMPPEIHYEAPLLERLSQLDSCVHPVLAFPDDVPTSLHFQSMLKSQWQNKPFDKIKPPKKLSLKHRAPMPGSLPDSARKDRHKLVSSFLTTAKLSHHQTRPDRTHRQHLDDVGAVPMVERVTAPKAERLLNPPPPVHDPNHSKMRLRDHSSERSEVLKHHTDMSSSSYLAATHHPPHSPLVRQLSTSSDSPAPASSSSQVTASTSQQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTPRHLASEDTRCSTPELGLDEQSVQPWERRTFPLAHSPQAECEDQLDAQERAARCTRRTSGSKTGRETEAAPTSPPIVPLKSRHLVAAATAQRPTHR

SEQ ID NO: 50595 - protein, 399 aa, Homo sapiens
MPPEIHYEAPLLERLSQLDSCVHPVLAFPDDVPTSLHFQSMLKSQWQNKPFDKIKPPKKLSLKHRAPMPGSLPDSARKDRHKLVSSFLTTAMLKHHTDMSSSSYLAATHHPPHSPLVRQLSTSSDSPAPASSSSQVTASTSQQPVRRRRGESSFDINNIVIPMSVAATTRVEKLQYKEILTPSWREVDLQSLKGSPDEENEEIEDLSDAAFAALHAKCEEMERARWLWTTSVPPQRRGSRSYRSSDGRTTPQLGSANPSTPQPASPDVSSSHSLSEYSHGQSPRSPISPELHSAPLTPVARDTPRHLASEDTRCSTPELGLDEQSVQPWERRTFPLAHSPQAECEDQLDAQERAARCTRRTSGSKTGRETEAAPTSPPIVPLKSRHLVAAATAQRPTHR

SEQ ID NO: 50596 - protein, 1105 aa, Homo sapiens; identical to SEQ ID NO: 50594

SEQ ID NO: 50597 - protein, 1105 aa, Homo sapiens; identical to SEQ ID NO: 50594

SEQ ID NO: 50598 - protein, 1105 aa, Homo sapiens; identical to SEQ ID NO: 50594

SEQ ID NO: 50599 - protein, 311 aa, Homo sapiens
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSGMRP

SEQ ID NO: 50600 - protein, 491 aa, Homo sapiens
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDIADLVEAKKLLKEAVVLPMWMPEFFKGIRRPWKGVLMVGPPGTGKTLLAKAVATECKTTFFNVSSSTLTSKYRGESEKLVRLLFEMARFYSPATIFIDEIDSICSRRGTSEEHEASRRVKAELLVQMDGVGGTSENDDPSKMVMVLAATNFPWDIDEALRRRLEKRIYIPLPSAKGREELLRISLRELELADDVDLASIAENMEGYSGADITNVCRDASLMAMRRRIEGLTPEEIRNLSKEEMHMPTTMEDFEMALKKVSKSVSAADIERYEKWIFEFGSC

SEQ ID NO: 50601 - protein, 491 aa, Homo sapiens; identical to SEQ ID NO: 50600

SEQ ID NO: 50602 - protein, 211 aa, Homo sapiens
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDI

SEQ ID NO: 50603 - protein, 280 aa, Homo sapiens
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKSHGNRPSTTVRVHRSSAQNVHNDRGKAVRCREKKEQNKGREEKNKSPAAVTEPETNKFDSTGYDKDLVEALERDIISQNPNVRWDDIADLVEAKKLLKEAVVLPMWMPEFFKGIRRPWKGVLMVGPPGTGKTLLAKAVATECKTTFFNVSSSTLTS

SEQ ID NO: 50604 - protein, 142 aa, Homo sapiens
MNCSESQRLRTLLSRLLLELHHRGNASGLGAGPRPSMGMGVVPDPFVGREVTSAKGDDAYLYILLIMIFYACLAGGLILAYTRSRKLVEAKDEPSQACAEHEWAPGGALTADAEAAAGSQAEGRRQLASEGLPALAQGAERV

SEQ ID NO: 50605 - protein, 502 aa, Homo sapiens
MFGTLLLYCFFLATVPALAETGGERQLSPEKSEIWGPGLKADVVLPARYFYIQAVDTSGNKFTSSPGEKVFQVKVSAPEEQFTRVGVQVLDRKDGSFIVRYRMYASYKNLKVEIKFQGQHVAKSPYILKGPVYHENCDCPLQDSAAWLREMNCPETIAQIQRDLAHFPAVDPEKIAVEIPKRFGQRQSLCHYTLKDNKVYIKTHGEHVGFRIFMDAILLSLTRKVKMPDVELFVNLGDWPLEKKKSNSNIHPIFSWCGSTDSKDIVMPTYDLTDSVLETMGRVSLDMMSVQANTGPPWESKNSTAVWRGRDSRKERLELVKLSRKHPELIDAAFTNFFFFKHDENLYGPIVKHISFFDFFKHKYQINIDGTVAAYRLPYLLVGDSVVLKQDSIYYEHFYNELQPWKHYIPVKSNLSDLLEKLKWAKDHDEEAKKIAKAGQEFARNNLMGDDIFCYYFKLFQEYANLQVSEPQIREGMKRVEPQTEDDLFPCTCHRKKTKDEL

SEQ ID NO: 50606 - protein, 354 aa, Homo sapiens
MSAGGGRAFAWQVFPPMPTCRVYGTVAHQDGHLLVLGGCGRAGLPLDTAETLDMASHTWLALAPLPTARAGAAAVVLGKQVLVVGGVDEVQSPVAAVEAFLMDEGRWERRATLPQAAMGVATVERDGMVYALGGMGPDTAPQAQVRVYEPRRDCWLSLPSMPTPCYGASTFLHGNKIYVLGGRQGKLPVTAFEAFDLEARTWTRHPSLPSRRAFAGCAMAEGSVFSLGGLQQPGPHNFYSRPHFVNTVEMFDLEHGSWTKLPRSLRMRDKRADFVVGSLGGHIVAIGGLGNQPCPLGSVESFSLARRRWEALPAMPTARCSCSSLQAGPRLFVIGGVAQGPSQAVEALCLRDGV

SEQ ID NO: 50607 - protein, 138 aa, Homo sapiens
MFDLEHGSWTKLPRSLRMRDKRADFVVGSLGGHIVAIGGLGNQPCPLGSVESFSLARRRWEALPAMPTARCSCSSLQAGPRLFVIGGVAQGPSQAVEALCLRDGEGLVGAVHWSSSLPEAAISMAPFAAEDTHCGSVG

SEQ ID NO: 50608 - protein, 606 aa, Homo sapiens
MDSQRELAEELRLYQSTLLQDGLKDLLDEKKFIDCTLKAGDKSLPCHRLILSACSPYFREYFLSEIDEAKKKEVVLDNVDPAILDLIIKYLYSASIDLNDGNVQDIFALASRFQIPSVFTVCVSYLQKRLAPGNCLAILRLGLLLDCPRLAISAREFVSDRFVQICKEEDFMQLSPQELISVISNDSLNVEKEEAVFEAVMKWVRTDKENRVKNLSEVFDCIRFRLMTEKYFKDHVEKDDIIKSNPDLQKKIKVLKDAFAGKLPEPSKNAAKTGAGEVNGDVGDEDLLPGYLNDIPRHGMFVKDLILLVNDTAAVAYDPTENECYLTALAEQIPRNHSSIVTQQNQIYVVGGLYVDEENKDQPLQSYFFQLDSIASEWVGLPPLPSARCLFGLGEVDDKIYVVAGKDLQTEASLDSVLCYDPVAAKWNEVKKLPIKVYGHNVISHKGMIYCLGGKTDDKKCTNRVFIFNPKKGDWKDLAPMKIPRSMFGVAVHKGKIVIAGGVTEDGLSASVEAFDLTTNKWDVMTEFPQERSSISLVSLAGSLYAIGGFAMIQLESKEFAPTEVNDIWKYEDDKKEWAGMLKEIRYASGASCLATRLNLFKLSKL

SEQ ID NO: 50609 - protein, 458 aa, Homo sapiens
MARGPQTLVQVWVGGQLFQADRALLVEHCGFFRGLFRSGMRETRAAEVRLGVLSAGGFRATLQVLRGDRPALAAEDELLQAVECAAFLQAPALARFLEHNLTSDNCALLCDAAAAFGLRDVFHSAALFICDGERELAAELALPEARAYVAALRPSSYAAVSTHTPAPGFLEDASRTLCYLDEEEDAWRTLAALPLEASTLLAGVATLGNKLYIVGGVRGASKEVVELGFCYDPDGGTWHEFPSPHQPRYDTALAGFDGRLYAIGGEFQRTPISSVERYDPAAGCWSFVADLPQPAAGVPCAQACGRLFVCLWRPADTTAVVEYAVRTDAWLPVAELRRPQSYGHCMVAHRDSLYVVRNGPSDDFLHCAIDCLNLATGQWTALPGQFVNSKGALFTAVVRGDTVYTVNRMFTLLYAIEGGTWRLLREKAGFPRPGSLQTFLLRLPPGAPGPVTSTTAEL

SEQ ID NO: 50610 - protein, 748 aa, Homo sapiens
MSGSGRKDFDVKHILRLRWKLFSHPSPSTGGPAGGGCLQQDGSGSFEHWGPSQSRLLKSQERSGVSTFWKKPSSSSSSSSSPSSSSSSFNPLNGTLLPVATRLQQGAPGQGTQQPARTLFYVESLEEEVVPGMDFPGPHEKGLVLQELKVEPDNSSQATGEGCGHRLSSTGHSMTPQSDLDSSSSEEFYQAVHHAEQTFRKMESYLKQQQLCDVILIVGNRKIPAHRLVLSSVSDYFAAMFTSDVCEAKQEEIKMEGIDPNALWDLVQFAYTGCLELKEDTIENLLAAACLLQLPQVVEVCCHFLMKLLHPSNCLGIRAFADAQGCIELMKVAHSYTMENIMEVIRNQEFLLLPAEELHKLLASDDVNVPDEETIFHALMMWVKYDMQSRCNDLSMLLAFIRLPLLPPQILADLENHALFKNDLECQKLILEAMKYHLLPERRTLMQSPRTKPRKSTVGTLYAVGGMDNNKGATTIEKYDLRTNLWIQAGMMNGRRLQFGVAVIDDKLFVIGGRDGLKTLNTVECYNPKTKTWTVLPPMSTHRHGLGVTVLEGPIYAVGGHDGWSYLNTVERWDPQSQQWTFVASMSIARSTVGVAALNGKLYSVGGRDGSSCLSSMEYYDPHTNKWNMCAPMCKRRGGVGVATCDGFLYAVGGHDAPASNHCSRLLDYVERYDPKTDTWTMVAPLSMPRDAVGVCLLGDRLYAVGGYDGQTYLNTMESYDPQTNEWTQMASLNIGRAGACVVVIKQP

SEQ ID NO: 50611 - protein, 555 aa, Homo sapiens
MDFPGPHEKGLVLQELKVEPDNSSQATGEGCGHRLVLSSVSDYFAAMFTSDVCEAKQEEIKMEGIDPNALWDLVQFAYTGCLELKEDTIENLLAAACLLQLPQVVEVCCHFLMKLLHPSNCLGIRAFADAQGCIELMKVAHSYTMENIMEVIRNQEFLLLPAEELHKLLASDDVNVPDEETIFHALMMWVKYDMQSRCNDLSMLLAFIRLPLLPPQILADLENHALFKNDLECQKLILEAMKYHLLPERRTLMQSPRTKPRKSTVGTLYAVGGMDNNKGATTIEKYDLRTNLWIQAGMMNGRRLQFGVAVIDDKLFVIGGRDGLKTLNTVECYNPKTKTWTVLPPMSTHRHGLGVTVLEGPIYAVGGHDGWSYLNTVERWDPQSQQWTFVASMSIARSTVGVAALNGKLYSVGGRDGSSCLSSMEYYDPHTNKWNMCAPMCKRRGGVGVATCDGFLYAVGGHDAPASNHCSRLLDYVERYDPKTDTWTMVAPLSMPRDAVGVCLLGDRLYAVGGYDGQTYLNTMESYDPQTNEWTQMASLNIGRAGACVVVIKQP

SEQ ID NO: 50612 - protein, 388 aa, Homo sapiens
MSRSGDRTSTFDPSHSDNLLHGLNLLWRKQLFCDVTLTAQGQQFHCHKAVLASCSQYFRSLFSSHPPLGGGVGGQDGLGAPKDQQQPPQQQPSQQQQPPPQEEPGTPSSSPDDKLLTSPRAINNLVLQGCSSIGLRLVLEYLYTANVTLSLDTVEEVLSVSKILHIPQVTKLCVQFLNDQISVQNYKQVCKIAALHGLEETKKLANKYLVEDVLLLNFEEMRALLDSLPPPVESELALFQMSVLWLEHDRETRMQYAPDLMKRLRFALIPAPELVERVQSVDFMRTDPVCQKLLLDAMNYHLMPFRQHCRQSLASRIRSNKKMLLLVGGLPPGPDRLPSNLVQYYDDEKKTWKILTITGPHPISGKQESASSPEFRRRKTREFSNNTM

SEQ ID NO: 50613 - protein, 628 aa, Homo sapiens
MSRSGDRTSTFDPSHSDNLLHGLNLLWRKQLFCDVTLTAQGQQFHCHKAVLASCSQYFRSLFSSHPPLGGGVGGQDGLGAPKDQQQPPQQQPSQQQQPPPQEEPGTPSSSPDDKLLTSPRAINNLVLQGCSSIGLRLVLEYLYTANVTLSLDTVEEVLSVSKILHIPQVTKLCVQFLNDQISVQNYKQVCKIAALHGLEETKKLANKYLVEDVLLLNFEEMRALLDSLPPPVESELALFQMSVLWLEHDRETRMQYAPDLMKRLRFALIPAPELVERVQSVDFMRTDPVCQKLLLDAMNYHLMPFRQHCRQSLASRIRSNKKMLLLVGGLPPGPDRLPSNLVQYYDDEKKTWKILTIMPYNSAHHCVVEVENFLFVLGGEDQWNPNGKHSTNFVSRYDPRFNSWIQLPPMQERRASFYACRLDKHLYVIGGRNETGYLSSVECYNLETNEWRYVSSLPQPLAAHAGAVHNGKIYISGGVHNGEYVPWLYCYDPVMDVWARKQDMNTKRAIHTLAVMNDRLYAIGGNHLKGFSHLDVMLVECYDPKGDQWNILQTPILEGRSGPGCAVLDDSIYLVGGYSWSMGAYKSSTICYCPEKGTWTELEGDVAEPLAGPACVTVILPSCVPYNK

SEQ ID NO: 50614 - protein, 597 aa, Homo sapiens
MVWLEARPQILFVCTKQGHQKPLDSKDDNTEKHCPVTVNPWHMKKAFKVMNELRSQNLLCDVTIVAEDMEISAHRVVLAACSPYFHAMFTGEMSESRAKRVRIKEVDGWTLRMLIDYVYTAEIQVTEENVQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQCLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 50615 - protein, 593 aa, Homo sapiens
METPPLPPACTKQGHQKPLDSKDDNTEKHCPVTVNPWHMKKAFKVMNELRSQNLLCDVTIVAEDMEISAHRVVLAACSPYFHAMFTGEMSESRAKRVRIKEVDGWTLRMLIDYVYTAEIQVTEENVQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQCLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 50616 - protein, 505 aa, Homo sapiens
MSESRAKRVRIKEVDGWTLRMLIDYVYTAEIQVTEENVQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCRAGMVYMAGLVFAVGGFNGSLRVRTVDSYDPVKDQWTSVANMRDRRSTLGAAVLNGLLYAVGGFDGSTGLSSVEAYNIKSNEWFHVAPMNTRRSSVGVGVVGGLLYAVGGYDGASRQCLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 50617 - protein, 587 aa, Homo sapiens
MEGESVKLSSQTLIQAGDDEKNQRTITVNPAHMGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKETRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRRSSVGVGVVEGKLYAVGGYDGASRQCLSTVEQYNPATNEWIYVADMSTRRSGAGVGVLSGQLYATGGHDGPLVRKSVEVYDPGTNTWKQVADMNMCRRNAGVCAVNGLLYVVGGDDGSCNLASVEYYNPVTDKWTLLPTNMSTGRSYAGVAVIHKSL

SEQ ID NO: 50618 - protein, 301 aa, Homo sapiens
MEGESVKLSSQTLIQAGDDEKNQRTITVNPAHMGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKETRLEHMAKLMEHVRLPLLPRDYLVQTVEEEALIKNNNTCKDFLIEAMKYHLLPLDQRLLIKNPRTKPRTPVSLPK

SEQ ID NO: 50619 - protein, 505 aa, Homo sapiens
MSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKETRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRRSSVGVGVVEGKLYAVGGYDGASRQCLSTVEQYNPATNEWIYVADMSTRRSGAGVGVLSGQLYATGGHDGPLVRKSVEVYDPGTNTWKQVADMNMCRRNAGVCAVNGLLYVVGGDDGSCNLASVEYYNPVTDKWTLLPTNMSTGRSYAGVAVIHKSL

SEQ ID NO: 50620 - protein, 200 aa, Homo sapiens
MSRCCSRQPACCSSWMFGRTAVTSCSLSCIPPIAWASVHLQMYTPALTFCSRPMPTQHFPEVMLGEEFLSLSLDQVCSLISSDKLTVSSEEKVFEAVISWINYEKETRLEHMAKLMEHVRLPLLPRDYLVQTVEEEALIKNNNTCKDFLIEAMKYHLLPLDQRLLIKNPRTKPRTPVSLPKGLECLADSCTPQVGMMGLW

SEQ ID NO: 50621 - protein, 555 aa, Homo sapiens
MGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKETRLEHMAKLMEHVRLPLLPRDYLVQTVEEEALIKNNNTCKDFLIEAMKYHLLPLDQRLLIKNPRTKPRTPVSLPKVMIVVGGQAPKAIRSVECYDFEEDRWDQIAELPSRRCRAGVVFMAGHVYAVGGFNGSLRVRTVDVYDGVKDQWTSIASMQERRSTLGAAVLNDLLYAVGGFDGSTGLASVEAYSYKTNEWFFVAPMNTRRSSVGVGVVEGKLYAVGGYDGASRQCLSTVEQYNPATNEWIYVADMSTRRSGAGVGVLSGQLYATGGHDGPLVRKSVEVYDPGTNTWKQVADMNMCRRNAGVCAVNGLLYVVGGDDGSCNLASVEYYNPVTDKWTLLPTNMSTGRSYAGVAVIHKSL

SEQ ID NO: 50622 - protein, 634 aa, Homo sapiens
MAPKKKIVKKNKGDINEMTIIVEDSPLNKLNALNGLLEGGNGLSCISSELTDASYGPNLLEGLSKMRQENFLCDLVIGTKTKSFDVHKSVMASCSEYFYNILKKDPSIQRVDLNDISPLGLATVIAYAYTGKLTLSLYTIGSIISAAVYLQIHTLVKMCSDFLIREMSVENCMYVVNIAETYSLKNAKAAAQKFIRDNFLEFAESDQFMKLTFEQINELLIDDDLQLPSEIVAFQIAMKWLEFDQKRVKYAADLLSNIRFGTISAQDLVNYVQSVPRMMQDADCHRLLVDAMNYHLLPYHQNTLQSRRTRIRGGCRVLVTVGGRPGLTEKSLSRDILYRDPENGWSKLTEMPAKSFNQCVAVMDGFLYVAGGEDQNDARNQAKHAVSNFCRYDPRFNTWIHLASMNQKRTHFSLSVFNGLVYAAGGRNAEGSLASLECYVPSTNQWQPKTPLEVARCCHASAVADGRVLVTGGYIANAYSRSVCAYDPASDSWQELPNLSTPRGWHCAVTLSDRVYVMGGSQLGPRGERVDVLTVECYSPATGQWSYAAPLQVGVSTAGVSALHGRAYLVGGWNEGEKKYKKCIQCFSPELNEWTEDDELPEATVGVSCCTLSMPNNVTRESRASSVSSVPVSI

SEQ ID NO: 50623 - protein, 634 aa, Homo sapiens; identical to SEQ ID NO: 50622

SEQ ID NO: 50624 - protein, 770 aa, Homo sapiens
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVFSHTFEDSKDHLVAIKQTIWRQNSLSEEFRSH

SEQ ID NO: 50625 - protein, 757 aa, Homo sapiens
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVWHSCFIITLTLFLLKQFLW

SEQ ID NO: 50626 - protein, 755 aa, Homo sapiens
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 50627 - protein, 282 aa, Homo sapiens
  MOD_RES (1)..(1): Any amino acid
XRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVFSHTFEDSKDHLVAIKQTIWRQNSLSEEFRSH

SEQ ID NO: 50628 - protein, 789 aa, Homo sapiens
MRLPGQGLGAREGPSIPLSSPAPAPASPAPPAWPPRPAVTHGRLRSPTRRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 50629 - protein, 349 aa, Homo sapiens
KKHPSTVMVPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 50630 - protein, 709 aa, Homo sapiens
MSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 50631 - protein, 694 aa, Homo sapiens
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 50632 - protein, 568 aa, Homo sapiens
MEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 50633 - protein, 621 aa, Homo sapiens
MLMAGQRGAWTMGDVVEKSLEGPLAPSTDEPSQKTGDLVEILNGEKVKFDDAGLSLILQNGLETLRMENALTDVILCVDIQEFSCHRVVLAAASNYFRAMFCNDLKEKYEKRIIIKGVDAETMHTLLDYTYTSKALITKQNVQRVLEAANLFQFLRMVDACASFLTEALNPENCVGILRLADTHSLDSLKKQVQSYIIQNFVQILNSEEFLDLPVDTLHHILKSDDLYVTEEAQVFETVMSWVRHKPSERLCLLPYVLENVRLPLLDPWYFVETVEADPLIRQCPEVFPLLQEARMYHLSGNEIISERTKPRMHEFQSEVFMIIGGCTKDERFVAEVTCLDPLRRSRLEVAKLPLTEHELESENKKWVEFACVTLKNEVYISGGKETQHDVWKYNSSINKWIQIEYLNIGRWRHKMVVLGGKVYVIGGFDGLQRINNVETYDPFHNCWSEAAPLLVHVSSFAATSHKKKLYVIGGGPNGKLATDKTQCYDPSTNKWSLKAAMPVEAKCINAVSFRDRIYVVGGAMRALYAYSPLEDSWCLVTQLSHERASCGIAPCNNRLYITGGRDEKNEVIATVLCWDPEAQKLTEECVLPRGVSHHGSVTIRKSYTHIRRIVPGAVSV

SEQ ID NO: 50634 - protein, 564 aa, Homo sapiens
MLGGTDCRTFLTSHINLKKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 50635 - protein, 586 aa, Homo sapiens
MAASGVEKSSKKKTEKKLAAREEAKLLAGFMGVMNNMRKQKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 50636 - protein, 538 aa, Homo sapiens
MVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 50637 - protein, 386 aa, Homo sapiens
MAASGVEKSSKKKTEKKLAAREEAKLLAGFMGVMNNMRKQKTLCDVILMVQERKIPAHRVVLAAASHFFNLMFTTNMLESKSFEVELKDAEPDIIEQLLHYKFFKMKNRKDGRVSVSYAILIQGLKIYEIYSTNFPEHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFCLIPVKFMILPQKHGLSCVQ

SEQ ID NO: 50638 - protein, 427 aa, Homo sapiens
MAASGVEKSSKKKTEKKLAAREEAKLLAGFMGVMNNMRKQKTLCDVILMVQERKIPAHRVVLAAASHFFNLMFTTNMLESKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 50639 - protein, 510 aa, Homo sapiens
MLESKSFEVELKDAEPDIIEQLVEFAYTARISVNSNNVQSLLDAANQYQIEPVKKMCVDFLKEQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 50640 - protein, 361 aa, Homo sapiens
MVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 50641 - protein, 564 aa, Homo sapiens; identical to SEQ ID NO: 50634

SEQ ID NO: 50642 - protein, 143 aa, Homo sapiens
MLGGTDCRTFLTSHINLKKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGKKYQIPVVCLFCFILYF

SEQ ID NO: 50643 - protein, 166 aa, Homo sapiens
MAASGVEKSSKKKTEKKLAAREEAKLLAGFMGVMNNMRKQKTLCDVILMVQERKIPAHRVVLAAASHFFNLMFTTNMLESKSFEVELKDAEPDIIEQLVEFAYTARISVNSNNVQSLLDAANQYQIEPVKKMCVDFLKEQVDASNCLGEAEKVDQSLPECGMLFTV

SEQ ID NO: 50644 - protein, 620 aa, Homo sapiens
MASDSMSSKQARNHITKGKRQQQHQQIKNRSSISDGDGEDSFIFEANEAWKDFHGSLLRFYENGELCDVTLKVGSKLISCHKLVLACVIPYFRAMFLSEMAEAKQTLIEIRDFDGDAIEDLVKFVYSSRLTLTVDNVQPLLYAACILQVELVARACCEYMKLHFHPSNCLAVRAFAESHNRIDLMDMADQYACDHFTEVVECEDFVSVSPQHLHKLLSSSDLNIENEKQVYNAAIKWLLANPQHHSKWLDETLAQVRLPLLPVDFLMGVVAKEQIVKQNLKCRDLLDEARNYHLHLSSRAVPDFEYSIRTTPRKHTAGVLFCVGGRGGSGDPFRSIECYSINKNSWFFGPEMNSRRRHVGVISVEGKVYAVGGHDGNEHLGSMEMFDPLTNKWMMKASMNTKRRGIALASLGGPIYAIGGLDDNTCFNDVERYDIESDQWSTVAPMNTPRGGVGSVALVNHVYAVGGNDGMASLSSVERYDPHLDKWIEVKEMGQRRAGNGVSKLHGCLYVVGGFDDNSPLSSVERYDPRSNKWDYVAALTTPRGGVGIATVMGKIFAVGGHNGNAYLNTVEAFDPVLNRWELVGSVSHCRAGAGVAVCSCLTSQIRDVGHGSNNVVDCM

SEQ ID NO: 50645 - protein, 620 aa, Homo sapiens; identical to SEQ ID NO: 50644

SEQ ID NO: 50646 - protein, 269 aa, Homo sapiens [sequence omitted]

SEQ ID NO: 50647 - protein, 624 aa, Homo sapiens
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPNFLQMQLQKCEILQSDSRCKDYLVKIFEELTLHKPTQVMPCRAPKVGRLIYTAGGYFRQSLSYLEAYNPSDGTWLRLADLQVPRSGLAGCVVGGLLYAVGGRNNSPDGNTDSSALDCYNPMTNQWSPCAPMSVPRNRIGVGVIDGHIYAVGGSHGCIHHNSVERYEPERDEWHLVAPMLTRRIGVGVAVLNRLLYAVGGFDGTNRLNSAECYYPERNEWRMITAMNTIRSGAGVCVLHNCIYAAGGYDGQDQLNSVERYDVETETWTFVAPMKHRRSALGITVHQGRIYVLGGYDGHTFLDSVECYDPDTDTWSEVTRMTSGRSGVGVAVTMEPCRKQIDQQNCTC

SEQ ID NO: 50648 - protein, 624 aa, Homo sapiens; identical to SEQ ID NO: 50647

SEQ ID NO: 50649 - protein, 732 aa, Homo sapiens
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVIQIDQPEFDVPLKQDQEQKIYAQIFREYLTYLNQLGTLLGGDPSKVQEHSSLSISITSRLFQFLRPLEQRRAQGKLFQMVTIDQLKEMAPAIDWLSCLQATFTPMSLSPSQSLVVHDVEYLKNMSQLVEEMLLKQRDFLQSHMILGLVVTLSPALDSQFQEARRKLSQKLRELTEQPPMPARPRWMKCVEETGTFFEPTLAALFVREAFGPSTRSAAMKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRAVNFGAAGSIMAHELLHIFYQLLLPGGCLACDNHALQEAHLCLKRHYAAFPLPSRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 50650 - protein, 644 aa, Homo sapiens
MSRQFSSRSGYRSGGGFSSGSAGIINYQRRTTSSSTRRSGGGGGRFSSCGGGGGSFGAGGGFGSRSLVNLGGSKSISISVARGGGRGSGFGGGYGGGGFGGGGFGGGGFGGGGIGGGGFGGFGSGGGGFGGGGFGGGGYGGGYGPVCPPGGIQEVTINQSLLQPLNVEIDPEIQKVKSREREQIKSLNNQFASFIDKVRFLEQQNQVLQTKWELLQQVDTSTRTHNLEPYFESFINNLRRRVDQLKSDQSRLDSELKNMQDMVEDYRNKYEDEINKRTNAENEFVTIKKDVDGAYMTKVDLQAKLDNLQQEIDFLTALYQAELSQMQTQISETNVILSMDNNRSLDLDSIIAEVKAQYEDIAQKSKAEAESLYQSKYEELQITAGRHGDSVRNSKIEISELNRVIQRLRSEIDNVKKQISNLQQSISDAEQRGENALKDAKNKLNDLEDALQQAKEDLARLLRDYQELMNTKLALDLEIATYRTLLEGEESRMSGECAPNVSVSVSTSHTTISGGGSRGGGGGGYGSGGSSYGSGGGSYGSGGGGGGGRGSYGSGGSSYGSGGGSYGSGGGGGGHGSYGSGSSSGGYRGGSGGGGGGSSGGRGSGGGSSGGSIGGRGSSSGGVKSSGGSSSVKFVSTTYSGVTR

SEQ ID NO: 50651 - protein, 584 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGIFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGHGGGHGGSSGGGYGGGSSGGGSSGGGYGGGSSSGGHGGSSSGGYGGGSSGGGGGGYGGGSSGGGSSSGGGYGGGSSSGGHKSSSSGSVGESSSKGPRY

SEQ ID NO: 50652 - protein, 494 aa, Homo sapiens
MDLSNNTMSLSVRTPGLSRRLSSQSVIGRPRGMSASSVGSGYGGSAFGFGASCGGGFSAASMFGSSSGFGGGSGSSMAGGLGAGYGRALGGGSFGGLGMGFGGSPGGGSLGILSGNDGGLLSGSEKETMQNLNDRLASYLDKVRALEEANTELENKIREWYETRGTGTADASQSDYSKYYPLIEDLRNKIISASIGNAQLLLQIDNARLAAEDFRMKYENELALRQGVEADINGLRRVLDELTLTRTDLEMQIESLNEELAYMKKNHEDELQSFRVGGPGEVSVEMDAAPGVDLTRLLNDMRAQYETIAEQNRKDAEAWFIEKSGELRKEISTNTEQLQSSKSEVTDLRRAFQNLEIELQSQLAMKKSLEDSLAEAEGDYCAQLSQVQQLISNLEAQLLQVRADAERQNVDHQRLLNVKARLELEIETYRRLLDGEAQGDGLEESLFVTDSKSQAQSTDSSKDPTKTRKIKTVVQEMVNGEVVSSQVQEIEELM

SEQ ID NO: 50653 - protein, 355 aa, Homo sapiens
MSLRLQSSSASYGGGFGGGSCQLGGGRGVSTCSTRFVSGGSAGGYGGGVSCGFGGGAGSGFGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAADDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHTKSAELNKEVSTNTAMIQTSKTEITELRRTLQGLEIELQSQLSMKAGLENTAADPGTHQQHRGPAERAPQ

SEQ ID NO: 50654 - protein, 458 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAADDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHTKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAKMIGFPSSAGSVSPRSTSVTTTSSASVTTTSNASGRRTSDVRRP

SEQ ID NO: 50655 - protein, 420 aa, Homo sapiens
MSLRLQSSSASYGGGFGGGSCQLGGGRGVSTCSTRFVSGGSAGGYGGGVSCGFGGGAGSGFGGGYGGGLGGGYGGGLGGGFGGGFAGGFVDFGACDGGLLTGNEKITMQNLNDRLASYLEKVRALEEANADLEVKIRDWHLKQSPASPERDYSPYYKTIEELRDKILTATIENNRVILEIDNARLAADDFRLKYENELALRQSVEADINGLRRVLDELTLSKTDLEMQIESLNEELAYMKKNHEEEMKEFSNQVVGQVNVEMDATPGIDLTRVLAEMREQYEAMAERNRRDAEEWFHTKSAELNKEVSTNTAMIQTSKTEITELRRTLQGLEIELQSQLSMKAGLENTVAETECRYALQLQQIQGLISSIEAQLSELRSEMECQNQEYKMLLDIKTRLEQEIATYRSLLEGQDAKKRQPP

SEQ ID NO: 50656 - protein, 456 aa, Homo sapiens
MTTTFLQTSSSTFGGGSTRGGSLLAGGGGFGGGSLSGGGGSRSISASSARFVSSGSGGGYGGGMRVCGFGGGAGSVFGGGFGGGVGGGFGGGFGGGDGGLLSGNEKITMQNLNDRLASYLDKVRALEEANADLEVKIHDWYQKQTPTSPECDYSQYFKTIEELRDKIMATTIDNSRVILEIDNARLAADDFRLKYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIAIREASSGGGGSSSNFHINVEESVDGQVVSSHKREI

SEQ ID NO: 50657 - protein, 291 aa, Homo sapiens
MTGTRSRPQPAQNATTANTSRPLKSSGTRYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAKMAGIAIREASSGGGGSSSNFHINVEESVDGQVVSSHKREI

SEQ ID NO: 50658 - protein, 456 aa, Homo sapiens; identical to SEQ ID NO: 50656

SEQ ID NO: 50659 - protein, 251 aa, Homo sapiens
MTGTRSRPQPAQNATTANTSRPLKSSGTRYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAK

SEQ ID NO: 50660 - protein, 220 aa, Homo sapiens
MTGTRSRPQPAQNATTANTSRPLKSSGTRYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQ

SEQ ID NO: 50661 - protein, 473 aa, Homo sapiens
MTTCSRQFTSSSSMKGSCGIGGGIGGGSSRISSVLAGGSCRAPSTYGGGLSVSSRFSSGGACGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPSEIKDYSPYFKTIEDLRNKIIAATIENAQPILQIDNARLAADDFRTKYEHELALRQTVEADVNGLRRVLDELTLARTDLEMQIEGLKEELAYLRKNHEEEMLALRGQTGGDVNVEMDAAPGVDLSRILNEMRDQYEQMAEKNRRDAETWFLSKTEELNKEVASNSELVQSSRSEVTELRRVLQGLEIELQSQLSMKASLENSLEETKGRYCMQLSQIQGLIGSVEEQLAQLRCEMEQQSQEYQILLDVKTRLEQEIATYRRLLEGEDAHLSSQQASGQSYSSREVFTSSSSSSSRQTRPILKEQSSSSFSQGQSS

SEQ ID NO: 50662 - protein, 432 aa, Homo sapiens
MTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELAYLKKNHEEEMNALRGQVGGEINVEMDAAPGVDLSRILNEMRDQYEKMAEKNRKDAEDWFFSKTEELNREVATNSELVQSGKSEISELRRTMQALEIELQSQLSMKASLEGNLAETENRYCVQLSQIQGLIGSVEEQLAQLRCEMEQQNQEYKILLDVKTRLEQEIATYRRLLEGEDAHLTQYKKEPVTTRQVRTIVEEVQDGKVISSREQVHQTTR

SEQ ID NO: 50663 - protein, 639 aa, Homo sapiens
MSCQISCKSRGRGGGGGGFRGFSSGSAVVSGGSRRSTSSFSCLSRHGGGGGGFGGGGFGSRSLVGLGGTKSISISVAGGGGGFGAAGGFGGRGGGFGGGSSFGGGSGFSGGGFGGGGFGGGRFGGFGGPGGVGGLGGPGGFGPGGYPGGIHEVSVNQSLLQPLNVKVDPEIQNVKAQEREQIKTLNNKFASFIDKVRFLEQQNQVLQTKWELLQQMNVGTRPINLEPIFQGYIDSLKRYLDGLTAERTSQNSELNNMQDLVEDYKKKYEDEINKRTAAENDFVTLKKDVDNAYMIKVELQSKVDLLNQEIEFLKVLYDAEISQIHQSVTDTNVILSMDNSRNLDLDSIIAEVKAQYEEIAQRSKEEAEALYHSKYEELQVTVGRHGDSLKEIKIEISELNRVIQRLQGEIAHVKKQCKNVQDAIADAEQRGEHALKDARNKLNDLEEALQQAKEDLARLLRDYQELMNVKLALDVEIATYRKLLEGEECRMSGDLSSNVTVSVTSSTISSNVASKAAFGGSGGRGSSSGGGYSSGSSSYGSGGRQSGSRGGSGGGGSISGGGYGSGGGSGGRYGSGGGSKGGSISGGGYGSGGGKHSSGGGSRGGSSSGGGYGSGGGGSSSVKGSSGEAFGSSVTFSFR

SEQ ID NO: 50664 - protein, 424 aa, Homo sapiens
MDFSRRSFHRSLSSSLQAPVVSTVGMQRLGTTPSVYGGAGGRGIRISNSRHTVNYGSDLTGGGDLFVGNEKMAMQNLNDRLASYLEKVRTLEQSNSKLEVQIKQWYETNAPRAGRDYSAYYRQIEELRSQIKDAQLQNARCVLQIDNAKLAAEDFRLKYETERGIRLTVEADLQGLNKVFDDLTLHKTDLEIQIEELNKDLALLKKEHQEEVDGLHKHLGNTVNVEVDAAPGLNLGVIMNEMRQKYEVMAQKNLQEAKEQFERQTAVLQQQVTVNTEELKGTEVQLTELRRTSQSLEIELQSHLSMKESLEHTLEETKARYSSQLANLQSLLSSLEAQLMQIRSNMERQNNEYHILLDIKTRLEQEIATYRRLLEGEDVKTTEYQLSTLEERDIKKTRKIKTVVQEVVDGKVVSSEVKEVEENI

SEQ ID NO: 50665 - protein, 525 aa, Homo sapiens
MSCSSRASSSRAGGSSSARVSAGGSSFSSGSRCGLGGSSAQGFRGGASSCSLSGGSSGAFGGSFGGGFGSCSVGGGFGGASGSGTGFGGGSSFGGVSGFGRGSGFCGSSRFSSGATGGFYSYGGGMGGGVGDGGLFSGGEKQTMQNLNDRLANYLDKVRALEEANTDLENKIKEWYDKYGPGSGDGGSGRDYSKYYSIIEDLRNQIIAATVENAGIILHIDNARLAADDFRLKYENELCLRQSVEADINGLRKVLDDLTMTRSDLEMQIESFTEELAYLRKNHEEEMKNMQGSSGGEVTVEMNAAPGTDLTKLLNDMRAQYEELAEQNRREAEERFNKQSASLQAQISTDAGAATSAKNEITELKRTLQALEIELQSQLAMKSSLEGTLADTEAGYVAQLSEIQTQISALEEEICQIWGETKCQNAEYKQLLDIKTRLEVEIETYRRLLDGEGGGSSFAEFGGRNSGSVNMGSRDLVSGDSRSGSCSGQGRDSSKTRVTKTIVEELVDGKVVSSQVSSISEVKVK

SEQ ID NO: 50666 - protein, 629 aa, Homo sapiens
MSRQASKTSGGGSQGFSGRSAVVSGSSRMSCVAHSGGAGGGAYGFRSGAGGFGSRSLYNLGGNKSISISVAAGGSRAGGFGGGRSSCAFAGGYGGGFGSGYGGGFGGGFGGGRGMGGGFGGAGGFGGAGGFGGAGGFGGPGGFGGSGGFGGPGSLGSPGGFGPGGFPGGIQEVTINQSLLQPLNVEIDPQIGQVKAQEREQIKTLNNKFASFIDKVRFLEQQNKVLETKWNLLQQQGTSSISGTNNLEPLFENHINYLRSYLDNILGERGRLDSELKNMEDLVEDFKKKYEDEINKRTAAENEFVTLKKDVDSAYMNKVELQAKVDALIDEIDFLRTLYDAELSQMQSHISDTSVVLSMDNNRSLDLDSIIAEVRAQYEDIAQRSKAEAEALYQTKLGELQTTAGRHGDDLRNTKSEIIELNRMIQRLRAEIEGVKKQNANLQTAIAEAEQHGEMALKDANAKLQELQAALQQAKDDLARLLRDYQELMNVKLALDVEIATYRKLLEGEEYSRMSGECPSAVSISVVSSSTTSASAGGYGGGYGGGMGGGLGGGFSAGGGSGSGFGRGGGGGIGGGFGGGSSGFSGGSGFGSISGARYGVSGGGFSSASNRGGSIKFSQSSQSSQRYSR

SEQ ID NO: 50667 - protein, 628 aa, Homo sapiens
MSRQASKTSGGGSQGFSGRSAVVSGSSRMSCVAHSGGAGGGAYGFRSGAGGFGSRSLYNLGGNKSISISVAAGGSRAGGFGGGRSSCAFAGGYGGGFGSGYGGGFGGGFGGGRGMGGGFGGAGGFGGAGGFGGAGGFGGPGGFGGSGGFGGPGSLGSPGGFGPGGFPGGIQEVTINQSLLQPLNVEIDPQIGQVKAQEREQIKTLNNKFASFIDKVRFLEQQNKVLETKWNLLQQQGTSSISGTNNLEPLFENHINYLRSYLDNILGERGRLDSELKNMEDLVEDFKKKYEDEINKRTAAENEFVTLKKDVDSAYMNKVELQAKVDALIDEIDFLRTLYDAELSQMQSHISDTSVVLSMDNNRSLDLDSIIAEVRAQYEDIAQRSKAEAEALYQTKLGELQTTAGRHGDDLRNTKSEIIELNRMIQRLRAEIEGVKKQNANLQTAIAEAEQHGEMALKDANAKLQELQAALQQAKDDLARLLRDYQELMNVKLALDVEIATYRKLLEGEEYRMSGECPSAVSISVVSSSTTSASAGGYGGGYGGGMGGGLGGGFSAGGGSGSGFGRGGGGGIGGGFGGGSSGFSGGSGFGSISGARYGVSGGGFSSASNRGGSIKFSQSSQSSQRYSR

SEQ ID NO: 50668 - protein, 416 aa, Homo sapiens [sequence omitted]

SEQ ID NO: 50669 - protein, 448 aa, Homo sapiens
MTSSCCVTNNLQASLKSCPRPASVCSSGVNCRPELCLGYVCQPMACLPSVCLPTTFRPASCLSKTYLSSSCQAASGISGSMGPGSWYSEGAFNGNEKETMQFLNDRLASYLTRVRQLEQENAELESRIQEASHSQVLTMTPDYQSHFRTIEELQQKILCTKAENARMVVNIDNAKLAADDFRAKYEAELAMRQLVEADINGLRRILDDLTLCKADLEAQVESLKEELMCLKKNHEEEVGSLRCQLGDRLNIEVDAAPPVDLTRVLEEMRCQYEAMVEANRRDVEEWFNMQMEELNQQVATSSEQLQNYQSDIIDLRRTVNTLEIELQAQHSLRDSLENTLTESEARYSSQLAQMQCMITNVEAQLAEIRADLERQNQEYQVLLDVRARLEGEINTYRSLLENEDCKLPCNPCSTPSCTTCVPSPCVPRTVCVPRTVGMPCSPCPQGRY

SEQ ID NO: 50670 - protein, 404 aa, Homo sapiens
MSYSCGLPSLSCRTSCSSRPCVPPSCHGCTLPGACNIPANVSNCNWFCEGSFNGSEKETMQFLNDRLASYLEKVRQLERDNAELENLIRERSQQQEPLVCASYQSYFKTIEELQQKILCSKSENARLVVQIDNAKLASDDFRTKYETELSLRQLVESDINGLRRILDELTLCRSDLEAQVESLKEELLCLKQNHEQEVNTLRCQLGDRLNVEVDAAPTVDLNQVLNETRSQYEALVETNRREVEQWFATQTEELNKQVVSSSEQLQSYQAEIIELRRTVNALEIELQAQHNLRDSLENTLTESEARYSSQLSQVQRLITNVESQLAEIRSDLERQNQEYQVLLDVRARLECEINTYRSLLESEDCKLPSNPCATTNACDKSTGPCISNPCGLRARCGPCNTFGY

SEQ ID NO: 50671 - protein, 404 aa, Homo sapiens
MPYNFCLPSLSCRTSCSSRPCVPPSCHGYTLPGACNIPANVSNCNWFCEGSFNGSEKETMQFLNDRLASYLEKVRQLERDNAELENLIRERSQQQEPLLCPSYQSYFKTIEELQQKILCSKSENARLVVQIDNAKLAADDFRTKYQTEQSLRQLVESDINSLRRILDELTLCRSDLEAQMESLKEELLSLKQNHEQEVNTLRCQLGDRLNVEVDAAPAVDLNQVLNETRNQYEALVETNRREVEQWFATQTEELNKQVVSSSEQLQSYQAEIIELRRTVNALEIELQAQHNLRYSLENTLTESEARYSSQLSQVQSLITNVESQLAEIRSDLERQNQEYQVLLDVRARLECEINTYRSLLESEDCKLPSNPCATTNACEKPIGSCVTNPCGPRSRCGPCNTFGY

SEQ ID NO: 50672 - protein, 436 aa, Homo sapiens
MLYAKPPPTINGIKGLQRKERLKPAHIHLQQLTCFSITCSSTMSYSCCLPSLGCRTSCSSRPCVPPSCHGYTLPGACNIPANVSNCNWFCEGSFNGSEKETMQFLNDRLASYLEKVRQLERDNAELEKLIQERSQQQEPLLCPSYQSYFKTIEELQQKILCAKAENARLVVNIDNAKLASDDFRSKYQTEQSLRLLVESDINSIRRILDELTLCKSDLESQVESLREELICLKKNHEEEVNTLRSQLGDRLNVEVDTAPTVDLNQVLNETRSQYEALVEINRREVEQWFATQTEELNKQVVSSSEQLQSCQAEIIELRRTVNALEIELQAQHNLRDSLENTLTESEAHYSSQLSQVQSLITNVESQLAEIRCDLERQNQEYQVLLDVRARLECEINTYRSLLESEDCKLPCNPCATTNASGNSCGPCGTSQKGCCN

SEQ ID NO: 50673 - protein, 394 aa, Homo sapiens
MSYSCCLPSLGCRTSCSSRPCVPPSCHGYTLPGACNIPANVSNCNWFCEGSFNGSEKETMQFLNDRLASYLEKVRQLERDNAELEKLIQERSQQQEPLLCPSYQSYFKTIEELQQKILCAKAENARLVVNIDNAKLASDDFRSKYQTEQSLRLLVESDINSIRRILDELTLCKSDLESQVESLREELICLKKNHEEEVNTLRSQLGDRLNVEVDTAPTVDLNQVLNETRSQYEALVEINRREVEQWFATQTEELNKQVVSSSEQLQSCQAEIIELRRTVNALEIELQAQHNLRDSLENTLTESEAHYSSQLSQVQSLITNVESQLAEIRCDLERQNQEYQVLLDVRARLECEINTYRSLLESEDCKLPCNPCATTNASGNSCGPCGTSQKGCCN

SEQ ID NO: 50674 - protein, 425 aa, Homo sapiens
MYSSSSCKLPSLSPVARSFSACSVGLGRSSYRATSCLPALCLPAGGFATSYSGGGGWFGEGILTGNEKETMQSLNDRLAGYLEKVRQLEQENASLESRIREWCEQQVPYMCPDYQSYFRTIEELQKKTLCSKAENARLVVEIDNAKLAADDFRTKYETEVSLRQLVESDINGLRRILDDLTLCKSDLEAQVESLKEELLCLKKNHEEEVNSLRCQLGDRLNVEVDAAPPVDLNRVLEEMRCQYETLVENNRRDAEDWLDTQSEELNQQVVSSSEQLQSCQAEIIELRRTVNALEIELQAQHSMRDALESTLAETEARYSSQLAQMQCMITNVEAQLAEIRADLERQNQEYQVLLDVRARLECEINTYRGLLESEDSKLPCNPCAPDYSPSKSCLPCLPAASCGPSAARTNCSPRPICVPCPGGRF

SEQ ID NO: 50675 - protein, 455 aa, Homo sapiens
MASKCLKAGFSSGSLKSPGGASGGSTRVSAMYSSSSCKLPSLSPVARSFSACSVGLGRSSYRATSCLPALCLPAGGFATSYSGGGGWFGEGILTGNEKETMQSLNDRLAGYLEKVRQLEQENASLESRIREWCEQQVPYMCPDYQSYFRTIEELQKKTLCSKAENARLVVEIDNAKLAADDFRTKYETEVSLRQLVESDINGLRRILDDLTLCKSDLEAQVESLKEELLCLKKNHEEEVNSLRCQLGDRLNVEVDAAPPVDLNRVLEEMRCQYETLVENNRRDAEDWLDTQSEELNQQVVSSSEQLQSCQAEIIELRRTVNALEIELQAQHSMRDALESTLAETEARYSSQLAQMQCMITNVEAQLAEIRADLERQNQEYQVLLDVRARLECEINTYRGLLESEDSKLPCNPCAPDYSPSKSCLPCLPAASCGPSAARTNCSPRPICVPCPGGRF

SEQ ID NO: 50676 - protein, 467 aa, Homo sapiens
MATQTCTPTFSTGSIKGLCGTAGGISRVSSIRSVGSCRVPSLAGAAGYISSARSGLSGLGSCLPGSYLSSECHTSGFVGSGGWFCEGSFNGSEKETMQFLNDRLANYLEKVRQLERENAELESRIQEWYEFQIPYICPDYQSYFKTIEDFQQKILLTKSENARLVLQIDNAKLAADDFRTKYETELSLRQLVEADINGLRRILDELTLCKADLEAQVESLKEELMCLKKNHEEEVSVLRCQLGDRLNVEVDAAPPVDLNKILEDMRCQYEALVENNRRDVEAWFNTQTEELNQQVVSSSEQLQCCQTEIIELRRTVNALEIELQAQHSMRNSLESTLAETEARYSSQLAQMQCLISNVEAQLSEIRCDLERQNQEYQVLLDVKARLEGEIATYRHLLEGEDCKLPPQPCATACKPVIRVPSVPPVPCVPSVPCTPAPQVGTQIRTITEEIRDGKVISSREHVQSRPL

SEQ ID NO: 50677 - protein, 417 aa, Homo sapiens
MLRSGLSGLGSCLPGSYLSSECHTSGFVGSGGWFCEGSFNGSEKETMQFLNDRLANYLEKVRQLERENAELESRIQEWYEFQIPYICPDYQSYFKTIEDFQQKILLTKSENARLVLQIDNAKLAADDFRTKYETELSLRQLVEADINGLRRILDELTLCKADLEAQVESLKEELMCLKKNHEEEVSVLRCQLGDRLNVEVDAAPPVDLNKILEDMRCQYEALVENNRRDVEAWFNTQTEELNQQVVSSSEQLQCCQTEIIELRRTVNALEIELQAQHSMRNSLESTLAETEARYSSQLAQMQCLISNVEAQLSEIRCDLERQNQEYQVLLDVKARLEGEIATYRHLLEGEDCKLPPQPCATACKPVIRVPSVPPVPCVPSVPCTPAPQVGTQIRTITEEIRDGKVISSREHVQSRPL

SEQ ID NO: 50678 - protein, 449 aa, Homo sapiens
MTSFYSTSSCPLGCTMAPGARNVFVSPIDVGCQPVAEANAASMCLLANVAHANRVRVGSTPLGRPSLCLPPTSHTACPLPGTCHIPGNIGICGAYGKNTLNGHEKETMKFLNDRLANYLEKVRQLEQENAELETTLLERSKCHESTVCPDYQSYFRTIEELQQKILCSKAENARLIVQIDNAKLAADDFRIKLESERSLHQLVEADKCGTQKLLDDATLAKADLEAQQESLKEEQLSLKSNHEQEVKILRSQLGEKFRIELDIEPTIDLNRVLGEMRAQYEAMVETNHQDVEQWFQAQSEGISLQAMSCSEELQCCQSEILELRCTVNALEVERQAQHTLKDCLQNSLCEAEDRYGTELAQMQSLISNLEEQLSEIRADLERQNQEYQVLLDVKARLENEIATYRNLLESEDCKLPCNPCSTPASCTSCPSCGPVTGGSPSGHGASMGR

SEQ ID NO: 50679 - protein, 456 aa, Homo sapiens
MTSSYSSSSCPLGCTMAPGARNVSVSPIDIGCQPGAEANIAPMCLLANVAHANRVRVGSTPLGRPSLCLPPTCHTACPLPGTCHIPGNIGICGAYGENTLNGHEKETMQFLNDRLANYLEKVRQLEQENAELEATLLERSKCHESTVCPDYQSYFHTIEELQQKILCSKAENARLIVQIDNAKLAADDFRIKLESERSLRQLVEADKCGTQKLLDDATLAKADLEAQQESLKEEQLSLKSNHEQEVKILRSQLGEKLRIELDIEPTIDLNRVLGEMRAQYEAMLETNRQDVEQWFQAQSEGISLQDMSCSEELQCCQSEILELRCTVNALEVERQAQHTLKDCLQNSLCEAEDRFGTELAQMQSLISNVEEQLSEIRADLERQNQEYQVLLDVKTRLENEIATYRNLLESEDCKLPCNPCSTSPSCVTAPCAPRPSCGPCTTCGPTCGASTTGSRF

SEQ ID NO: 50680 - protein, 594 aa, Homo sapiens
MTSVGVFSDMLNGCGKDGLVPRAKPRDVSDFSLYAPATKPCCSRTYKRRRLRAPALTGLGPVTSLIAPSSLSAAMIARQQCVRGGPRGFSCGSAIVGGGKRGAFSSVSMSGGAGRCSSGGFGSRSLYNLRGNKSISMSVAGSRQGACFGGAGGFGTGGFGGGFGGSFSGKGGPGFPVCPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 50681 - protein, 500 aa, Homo sapiens
MIARQQCVRGGPRGFSCGSAIVGGGKRGAFSSVSMSGGAGRCSSGGFGSKGACFGGAGGFGTGGFGGGFGGSFSGKGGPGFPVCPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 50682 - protein, 520 aa, Homo sapiens
MIARQQCVRGGPRGFSCGSAIVGGGKRGAFSSVSMSGGAGRCSSGGFGSRSLYNLRGNKSISMSVAGSRQGACFGGAGGFGTGGFGGGFGGSFSGKGGPGFPVCPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 50683 - protein, 564 aa, Homo sapiens
MASTSTTIRSHSSSRRGFSANSARLPGVSRSGFSSVSVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPTIQRVRAEEREQIKTLNNKFASFIDKVRFLEQQNKVLETKWTLLQEQGTKTVRQNLEPLFEQYINNLRRQLDSIVGERGRLDSELRGMQDLVEDFKNKYEDEINKRTAAENEFVTLKKDVDAAYMNKVELQAKADTLTDEINFLRALYDAELSQMQTHISDTSVVLSMDNNRNLDLDSIIAEVKAQYEEIAQRSRAEAESWYQTKYEELQVTAGRHGDDLRNTKQEIAEINRMIQRLRSEIDHVKKQCANLQAAIADAEQRGEMALKDAKNKLEGLEDALQKAKQDLARLLKEYQELMNVKLALDVEIATYRKLLEGEECRLNGEGVGQVNISVVQSTVSSGYGGASGVGSGLGLGGGSSYSYGSGLGVGGGFSSSSGRAIGGGLSSVGGGSSTIKYTTTSSSSRKSYKH

SEQ ID NO: 50684 - protein, 520 aa, Homo sapiens
MASTSTTIRSHSGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPTIQRVRAEEREQIKTLNNKFASFIDKVRFLEQQNKVLETKWTLLQEQGTKTVRQNLEPLFEQYINNLRRQLDSIVGERGRLDSELRGMQDLVEDFKNKYEDEINKRTAAENEFVTLKKDVDAAYMNKVELQAKADTLTDEINFLRALYDAELSQMQTHISDTSVVLSMDNNRNLDLDSIIAEVKAQYEEIAQRSRAEAESWYQTKYEELQVTAGRHGDDLRNTKQEIAEINRMIQRLRSEIDHVKKQCANLQAAIADAEQRGEMALKDAKNKLEGLEDALQKAKQDLARLLKEYQELMNVKLALDVEIATYRKLLEGEECRLNGEGVGQVNISVVQSTVSSGYGGASGVGSGLGLGGGSSYSYGSGLGVGGGFSSSSGRAIGGGLSSVGGGSSTIKYTTTSSSSRKSYKH

SEQ ID NO: 50685 - protein, 564 aa, Homo sapiens
MASTSTTIRSHSSSRRGFSANSARLPGVSRSGFSSISVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPAIQRVRAEEREQIKTLNNKFASFIDKVRFLEQQNKVLDTKWTLLQEQGTKTVRQNLEPLFEQYINNLRRQLDNIVGERGRLDSELRNMQDLVEDLKNKYEDEINKRTAAENEFVTLKKDVDAAYMNKVELQAKADTLTDEINFLRALYDAELSQMQTHISDTSVVLSMDNNRNLDLDSIIAEVKAQYEEIAQRSRAEAESWYQTKYEELQITAGRHGDDLRNTKQEIAEINRMIQRLRSEIDHVKKQCANLQAAIADAEQRGEMALKDAKNKLEGLEDALQKAKQDLARLLKEYQELMNVKLALDVEIATYRKLLEGEECRLNGEGVGQVNISVVQSTVSSGYGGASGVGSGLGLGGGSSYSYGSGLGVGGGFSSSSGRATGGGLSSVGGGSSTIKYTTTSSSSRKSYKH

SEQ ID NO: 50686 - protein, 524 aa, Homo sapiens
MASTSTTIRSHSSSRRGFSANSARLPGVSRSGFSSISVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPAIQRVRAEEREQIKTLNNKFASFIDKVRFLEQQNKVLDTKWTLLQEQGTKTVRQNLEPLFEQYINNLRRQLDNIVGERGRLDSELRNMQDLVEDLKNKDEINFLRALYDAELSQMQTHISDTSVVLSMDNNRNLDLDSIIAEVKAQYEEIAQRSRAEAESWYQTKYEELQITAGRHGDDLRNTKQEIAEINRMIQRLRSEIDHVKKQCANLQAAIADAEQRGEMALKDAKNKLEGLEDALQKAKQDLARLLKEYQELMNVKLALDVEIATYRKLLEGEECRLNGEGVGQVNISVVQSTVSSGYGGASGVGSGLGLGGGSSYSYGSGLGVGGGFSSSSGRATGGGLSSVGGGSSTIKYTTTSSSSRKSYKH

SEQ ID NO: 50687 - protein, 564 aa, Homo sapiens
MASTSTTIRSHSSSRRGFSANSARLPGVSRSGFSSISVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPAIQRVRAEEREQIKTLNNKFASFIDKVRFLEQQNKVLDTKWTLLQEQGTKTVRQNLEPLFEQYINNLRRQLDSIVGERGRLDSELRNMQDLVEDLKNKYEDEINKRTAAENEFVTLKKDVDAAYMNKVELQAKADTLTDEINFLRALYDAELSQMQTHISDTSVVLSMDNNRNLDLDSIIAEVKAQYEEIAQRSRAEAESWYQTKYEELQVTAGRHGDDLRNTKQEIAEINRMIQRLRSEIDHVKKQCASLQAAIADAEQRGEMALKDAKNKLEGLEDALQKAKQDLARLLKEYQELMNVKLALDVEIATYRKLLEGEECRLNGEGVGQVNVSVVQSTISSGYGGASGVGSGLGLGGGSSYSYGSGLGIGGGFSSSSGRAIGGGLSSVGGGSSTIKYTTTSSSSRKSYKH

SEQ ID NO: 50688 - protein, 549 aa, Homo sapiens
MASTSTTIRSHSSSRSGFSSISVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPAIQRVRAEEREQIKTLNNKFASFIDKVRFLEQQNKVLDTKWTLLQEQGTKTVRQNLEPLFEQYINNLRRQLDSIVGERGRLDSELRNMQDLVEDLKNKYEDEINKRTAAENEFVTLKKDVDAAYMNKVELQAKADTLTDEINFLRALYDAELSQMQTHISDTSVVLSMDNNRNLDLDSIIAEVKAQYEEIAQRSRAEAESWYQTKYEELQVTAGRHGDDLRNTKQEIAEINRMIQRLRSEIDHVKKQCASLQAAIADAEQRGEMALKDAKNKLEGLEDALQKAKQDLARLLKEYQELMNVKLALDVEIATYRKLLEGEECRLNGEGVGQVNVSVVQSTISSGYGGASGVGSGLGLGGGSSYSYGSGLGIGGGFSSSSGRAIGGGLSSVGGGSSTIKYTTTSSSSRKSYKH

SEQ ID NO: 50689 - protein, 523 aa, Homo sapiens
MSRQFTCKSGAAAKGGFSGCSAVLSGGSSSSFRAGSKGLSGGFGSRSLYSLGGVRSLNVASGSGKSGGYGFGRGRASGFAGSMFGSVALGPVCPTVCPPGGIHQVTVNESLLAPLNVELDPEIQKVRAQEREQIKALNNKFASFIDKVRFLEQQNQVLETKWELLQQLDLNNCKNNLEPILEGYISNLRKQLETLSGDRVRLDSELRNVRDVVEDYKKRYEEEINKRTAAENEFVLLKKDVDAAYANKVELQAKVESMDQEIKFFRCLFEAEITQIQSHISDMSVILSMDNNRNLDLDSIIDEVRTQYEEIALKSKAEAEALYQTKFQELQLAAGRHGDDLKNTKNEISELTRLIQRIRSEIENVKKQASNLETAIADAEQRGDNALKDARAKLDELEGALHQAKEELARMLREYQELMSLKLALDMEIATYRKLLESEECRMSGEFPSPVSISIISSTSGGSVYGFRPSMVSGGYVANSSNCISGVCSVRGGEGRSRGSANDYKDTLGKGSSLSAPSKKTSR

SEQ ID NO: 50690 - protein, 511 aa, Homo sapiens
MSRQLTHFPRGERLGFSGCSAVLSGGIGSSSASFRARVKGSASFGSKSLSCLGGSRSLALSAAARRGGGRLGGFVGTAFGSAGLGPKCPSVCPPGGIPQVTVNKSLLAPLNVEMDPEIQRVRAQEREQIKALNNKFASFIDKVRFLEQQNQVLETKWNLLQQLDLNNCRKNLEPIYEGYISNLQKQLEMLSGDGVRLDSELRNMQDLVEDYKKRYEVEINRRTAAENEFVVLKKDVDAAYMNKVELQAKVDSLTDEIKFFKCLYEGEITQIQSHISDTSIVLSMDNNRDLDLDSIIAEVRAQYEEIALKSKAEAETLYQTKIQELQVTAGQHGDDLKLTKAEISELNRLIQRIRSEIGNVKKQCADLETAIADAEQRGDCALKDARAKLDELEGALHQAKEELARMLREYQELVSLKLALDMEIATYRKLLESEECRMSGEYPNSVSISVISSTNAGAGGAGFSMGFGASSSYSYKTAAADVKTKGSCGSELKDPLAKTSGSSCATKKASR

SEQ ID NO: 50691 - protein, 469 aa, Homo sapiens
MSRQLTHFPRGERLGFSGCSAVLSGGIGSSSASFRARVKGSASFGSKSLSCLGGSRSLALSAAARRGGGRLGGFVGTAFGSAGLGPKCPSVCPPGGIPQVTVNKSLLAPLNVEMDPEIQRVRAQEREQIKALNNKFASFIDKVRFLEQQNQVLETKWNLLQQLDLNNCRKNLEPIYEGYISNLQKQLEMLSGDGVRLDSELRNMQDLVEDYKKRYEVEINRRTAAENEFVVLKKDVDAAYMNKVELQAKVDSLTDEIKFFKCLYEGEITQIQSHISDTSIVLSMDNNRDLDLDSIIAEVRAQYEEIALKSKAEAETLYQTKCADLETAIADAEQRGDCALKDARAKLDELEGALHQAKEELARMLREYQELVSLKLALDMEIATYRKLLESEECRMSGEYPNSVSISVISSTNAGAGGAGFSMGFGASSSYSYKTAAADVKTKGSCGSELKDPLAKTSGSSCATKKASR

SEQ ID NO: 50692 - protein, 323 aa, Homo sapiens
MLSGDGVRLDSELRNMQDLVEDYKKRYEVEINRRTAAENEFVVLKKDVDAAYMNKVELQAKVDSLTDEIKFFKCLYEGEITQIQSHISDTSIVLSMDNNRDLDLDSIIAEVRAQYEEIALKSKAEAETLYQTKIQELQVTAGQHGDDLKLTKAEISELNRLIQRIRSEIGNVKKQCADLETAIADAEQRGDCALKDARAKLDELEGALHQAKEELARMLREYQELVSLKLALDMEIATYRKLLESEECRMSGEYPNSVSISVISSTNAGAGGAGFSMGFGASSSYSYKTAAADVKTKGSCGSELKDPLAKTSGSSCATKKASR

SEQ ID NO: 50693 - protein, 511 aa, Homo sapiens; identical to SEQ ID NO: 50690

SEQ ID NO: 50694 - protein, 540 aa, Homo sapiens
MSRQFTYKSGAAAKGGFSGCSAVLSGGSSSSYRAGGKGLSGGFSSRSLYSLGGARSISFNVASGSGWAGGYGFGRGRASGFAGSMFGSVALGSVCPSLCPPGGIHQVTINKSLLAPLNVELDPEIQKVRAQEREQIKVLNNKFASFIDKVRFLEQQNQVLETKWELLQQLDLNNCKNNLEPILEGYISNLRKQLETLSGDRVRLDSELRSVREVVEDYKKRYEEEINKRTTAENEFVVLKKDVDAAYTSKVELQAKVDALDGEIKFFKCLYEGETAQIQSHISDTSIILSMDNNRNLDLDSIIAEVRAQYEEIARKSKAEAEALYQTKFQELQLAAGRHGDDLKHTKNEISELTRLIQRLRSEIESVKKQCANLETAIADAEQRGDCALKDARAKLDELEGALQQAKEELARMLREYQELLSVKLSLDIEIATYRKLLEGEECRMSGEYTNSVSISVINSSMAGMAGTGAGFGFSNAGTYGYWPSSVSGGYSMLPGGCVTGSGNCSPRGEARTRLGSASEFRDSQGKTLALSSPTKKTMR

SEQ ID NO: 50695 - protein, 529 aa, Homo sapiens
MSRQLNIKSSGDKGNFSVHSAVVPRKAVGSLASYCAAGRGAGAGFGSRSLYSLGGNRRISFNVAGGGVRAGGYGFRPGSGYGGGRASGFAGSMFGSVALGPACLSVCPPGGIHQVTVNKSLLAPLNVELDPEIQKVRAQEREQIKVLNDKFASFIDKVRFLEQQNQVLETKWELLQQLDLNNCKKNLEPILEGYISNLRKQLETLSGDRVRLDSELRSMRDLVEDYKKRYEVEINRRTTAENEFVVLKKDADAAYAVKVELQAKVDSLDKEIKFLKCLYDAEIAQIQTHASETSVILSMDNNRDLDLDSIIAEVRMHYEEIALKSKAEAEALYQTKIQELQLAASRHGDDLKHTRSEMVELNRLIQRIRCEIGNVKKQRASLETAIADAEQRGDNALKDAQAKLDELEGALHQAKEELARMLREYQELMSLKLALDMEIATYRKLLEGEECRMSGENPSSVSISVISSSSYSYHHPSSAGVDLGASAVAGSSGSTQSGQTKTTEARGGDLKDTQGKSTPASIPARKATR

SEQ ID NO: 50696 - protein, 551 aa, Homo sapiens
MSRQSSITFQSGSRRGFSTTSAITPAAGRSRFSSVSVARSAAGSGGLGRISSAGASFGSRSLYNLGGAKRVSINGCGSSCRSGFGGRASNRFGVNSGFGYGGGVGGGFSGPSFPVCPPGGIQEVTVNQSLLTPLHLQIDPTIQRVRAEEREQIKTLNNKFASFIDKVRFLEQQNKVLETKWALLQEQGSRTVRQNLEPLFDSYTSELRRQLESITTERGRLEAELRNMQDVVEDFKVRYEDEINKRTAAENEFVALKKDVDAAYMNKVELEAKVKSLPEEINFIHSVFDAELSQLQTQVGDTSVVLSMDNNRNLDLDSIIAEVKAQYEDIANRSRAEAESWYQTKYEELQVTAGRHGDDLRNTKQEISEMNRMIQRLRAEIDSVKKQCSSLQTAIADAEQRGELALKDARAKLVDLEEALQKAKQDMARLLREYQELMNIKLALDVEIATYRKLLEGEECRLSGEGVSPVNISVVTSTLSSGYGSGSSIGGGNLGLGGGSGYSFTTSGGHSLGAGLGGSGFSATSNRGLGGSGSSVKFVSTTSSSQKSYTH

SEQ ID NO: 50697 - protein, 578 aa, Homo sapiens
MSHQFSSQSAFSSMSRRVYSTSSSAGSGGGSPAVGSVCYARGRCGGGGYGIHGRGFGSRSLYNLGGSRSISINLMGRSTSGFCQGGGVGGFGGGRGFGVGSTGAGGFGGGGFGGAGFGTSNFGLGGFGPYCPPGGIQEVTINQSLLEPLHLEVDPEIQRIKTQEREQIMVLNNKFASFIDKVRFLEQQNQVLQTKWELLQQVNTSTGTNNLEPLLENYIGDLRRQVDLLSAEQMRQNAEVRSMQDVVEDYKSKYEDEINKRTGSENDFVVLKKDVDAAYVSKVDLESRVDTLTGEVNFLKYLFLTELSQVQTHISDTNVILSMDNNRSLDLDSIIDAVRTQYELIAQRSKDEAEALYQTKYQELQITAGRHGDDLKNSKMEIAELNRTVQRLQAEISNVKKQIEQMQSLISDAEERGEQALQDAWQKLQDLEEALQQSKEELARLLRDYQAMLGVKLSLDVEIATYRQLLEGEESRMSGELQSHVSISVQNSQVSVNGGAGGGGSYGSGGYGGGSGGGYGGGRSYRGGGARGRSGGGYGSGCGGGGGSYGGSGRSGRGSSRVQIIQTSTNTSHRRILE

SEQ ID NO: 50698 - protein, 345 aa, Homo sapiens
MRQNAEVRSMQDVVEDYKSKYEDEINKRTGSENDFVVLKKDVDAAYVSKVDLESRVDTLTGEVNFLKYLFLTELSQVQTHISDTNVILSMDNNRSLDLDSIIDAVRTQYELIAQRSKDEAEALYQTKYQELQITAGRHGDDLKNSKMEIAELNRTVQRLQAEISNVKKQIEQMQSLISDAEERGEQALQDAWQKLQDLEEALQQSKEELARLLRDYQAMLGVKLSLDVEIATYRQLLEGEESRMSGELQSHVSISVQNSQVSVNGGAGGGGSYGSGGYGGGSGGGYGGGRSYRGGGARGRSGGGYGSGCGGGGGSYGGSGRSGRGSSRVQIIQTSTNTSHRRILE

SEQ ID NO: 50699 - protein, 520 aa, Homo sapiens
MSLSPCRAQRGFSARSACSARSRGRSRGGFSSRGGFSSRSLNSFGGCLEGSRGSTWGSGGRLGVRFGEWSGGPGLSLCPPGGIQEVTINQNLLTPLKIEIDPQFQVVRTQETQEIRTLNNQFASFIDKVRFLEQQNKVLETKWHLLQQQGLSGSQQGLEPVFEACLDQLRKQLEQLQGERGALDAELKACRDQEEEYKSKYEEEAHRRATLENDFVVLKKDVDGVFLSKMELEGKLEALREYLYFLKHLNEEELGQLQTQASDTSVVLSMDNNRYLDFSSIITEVRARYEEIARSSKAEAEALYQTKYQELQVSAQLHGDRMQETKVQISQLHQEIQRLQSQTENLKKQNASLQAAITDAEQRGELALKDAQAKVDELEAALRMAKQNLARLLCEYQELTSTKLSLDVEIATYRRLLEGEECRMSGECTSQVTISSVGGSAVMSGGVGGGLGSTCGLGSGKGSPGSCCTSIVTGGSNIILGSGKDPVLDSCSVSGSSAGSSCHTILKKTVESSLKTSITY

SEQ ID NO: 50700 - protein, 410 aa, Homo sapiens
MEGHEASPAQVGQGDRGKVRFLEQQNKVLETKWHLLQQQGLSGSQQGLEPVFEACLDQLRKQLEQLQGERGALDAELKACRDQEEEYKSKYEEEAHRRATLENDFVVLKKDVDGVFLSKMELEGKLEALREYLYFLKHLNEEELGQLQTQASDTSVVLSMDNNRYLDFSSIITEVRARYEEIARSSKAEAEALYQTKYQELQVSAQLHGDRMQETKVQISQLHQEIQRLQSQTENLKKQNASLQAAITDAEQRGELALKDAQAKVDELEAALRMAKQNLARLLCEYQELTSTKLSLDVEIATYRRLLEGEECRMSGECTSQVTISSVGGSAVMSGGVGGGLGSTCGLGSGKGSPGSCCTSIVTGGSNIILGSGKDPVLDSCSVSGSSAGSSCHTILKKTVESSLKTSITY

SEQ ID NO: 50701 - protein, 291 aa, Homo sapiens
MELEGKLEALREYLYFLKHLNEEELGQLQTQASDTSVVLSMDNNRYLDFSSIITEVRARYEEIARSSKAEAEALYQTKYQELQVSAQLHGDRMQETKVQISQLHQEIQRLQSQTENLKKQNASLQAAITDAEQRGELALKDAQAKVDELEAALRMAKQNLARLLCEYQELTSTKLSLDVEIATYRRLLEGEECRMSGECTSQVTISSVGGSAVMSGGVGGGLGSTCGLGSGKGSPGSCCTSIVTGGSNIILGSGKDPVLDSCSVSGSSAGSSCHTILKKTVESSLKTSITY

SEQ ID NO: 50702 - protein, 535 aa, Homo sapiens
MRSSVSRQTYSTKGGFSSNSASGGSGSQARTSFSSVTVSRSSGSGGGAHCGPGTGGFGSRSLYNLGGHKSISVSVAGGALLGRALGGFGFGSRAFMGQGAGRQTFGPACPPGGIQEVTVNQSLLTPLHVEIDPEIQRVRTQEREQIKTLNNKFASFIDKVRFLEQQNKVLETKWALLQEQGQNLGVTRNNLEPLFEAYLGSMRSTLDRLQSERGRLDSELRNVQDLVEDFKNKYEDEINKHTAAENEFVVLKKDVDAAYMGRMDLHGKVGTLTQEIDFLQQLYEMELSQVQTHVSNTNVVLSMDNNRNLDLDSIIAEVKAQYELIAQRSRAEAEAWYQTKYEELQVTAGKHGDNLRDTKNEIAELTRTIQRLQGEADAAKKQCQQLQTAIAEAEQRGELALKDAQKKLGDLDVALHQAKEDLTRLLRDYQELMNVKLALDVEIATYRKLLESEESRMSGECPSAVSISVTGNSTTVCGGGAASFGGGISLGGSGGATKGGFSTNVGYSTVKGGPVSAGTSILRKTTTVKTSSQRY

SEQ ID NO: 50703 - protein, 422 aa, Homo sapiens
MACRSCVVGFSSLSSCEVTPVGSPRPGTSGWDSCRAPGPGFSSRSLTGCWSAGTISKVTVNPGLLVPLDVKLDPAVQQLKNQEKEEMKALNDKFASLIGKVQALEQRNQLLETRWSFLQGQDSAIFDLGHLYEEYQGRLQEELRKVSQERGQLEANLLQVLEKVEEFRIRYEDEISKRTDMEFTFVQLKKDLDAECLHRTELETKLKSLESFVELMKTIYEQELKDLAAQVKDVSVTVGMDSRCHIDLSGIVEEVKAQYDAVAARSLEEAEAYSRSQLEEQAARSAEYGSSLQSSRSEIADLNVRIQKLRSQILSVKSHCLKLEENIKTAEEQGELAFQDAKTKLAQLEAALQQAKQDMARQLRKYQELMNVKLALDIEIATYRKLVEGEEGRMDSPSATVVSAVQSRCKTAPSLPYPLCSL

SEQ ID NO: 50704 - protein, 452 aa, Homo sapiens
MACRSCVVGFSSLSSCEVTPVGSPRPGTSGWDSCRAPGPGFSSRSLTGCWSAGTISKVTVNPGLLVPLDVKLDPAVQQLKNQEKEEMKALNDKFASLIGKVQALEQRNQLLETRWSFLQGQDSAIFDLGHLYEEYQGRLQEELRKVSQERGQLEANLLQVLEKVEEFRIRYEDEISKRTDMEFTFVQLKKDLDAECLHRTELETKLKSLESFVELMKTIYEQELKDLAAQVKDVSVTVGMDSRCHIDLSGIVEEVKAQYDAVAARSLEEAEAYSRSQLEEQAARSAEYGSSLQSSRSEIADLNVRIQKLRSQILSVKSHCLKLEENIKTAEEQGELAFQDAKTKLAQLEAALQQAKQDMARQLRKYQELMNVKLALDIEIATYRKLVEGEEGRMDSPSATVVSAVQSRCKTAASRSGLSKAPSRKKKGSKGPVIKITEMSEKYFSQESEVSE

SEQ ID NO: 50705 - protein, 505 aa, Homo sapiens
MTCGSGFGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFEGYIETLRREAECVEADSGRLASELNHVQEVLEGYKKKYEEEVSLRATAENEFVALKKDVDCAYLRKSDLEANVEALIQEIDFLRRLYEEEILILQSHISDTSVVVKLDNSRDLNMDCIIAEIKAQYDDIVTRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGIGAVNVCVSSSRGGVVCGDLCVSGSRPVTGSVCSAPCNGNVAVSTGLCAPCGQLNTTCGGGSCGVGSCGISSLGVGSCGSSCRKC

SEQ ID NO: 50706 - protein, 484 aa, Homo sapiens
MTCGSGFGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFEGYIETLRREAECVEADSGRLASELNHVQEVLEGYKKKYEEEVSLRATAENEFVALKKDVDCAYLRKSDLEANVEALIQEIDFLRRLYEEEILILQSHISDTSVVVKLDNSRDLNMDCIIAEIKAQYDDIVTRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGIGAVNVCVSSSRGGVVCGDLCVSGSRPVTGSVCSAPCNGNVAVSTGLCAPCGQVGSCGSSCRKC

SEQ ID NO: 50707 - protein, 493 aa, Homo sapiens
MTCGFNSIGCGFRPGNFSCVSACGPRPSRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFAGYIETLRREAECVEADSGRLASELNHVQEVLEGYKKKYEEEVALRATAENEFVALKKDVDCAYLRKSDLEANVEALIQEIDFLRRLYEEEIRILQSHISDTSVVVKLDNSRDLNMDCIVAEIKAQYDDIATRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGVEAVNVCVSSSRGGVVCGDLCVSGSRPVTGSVCSAPCNGNLVVSTGLCKPCGQLNTTCGGGSCGQGRH

SEQ ID NO: 50708 - protein, 507 aa, Homo sapiens
MSCRSYRISSGCGVTRNFSSCSAVAPKTGNRCCISAAPYRGVSCYRGLTGFGSRSLCNLGSCGPRIAVGGFRAGSCGRSFGYRSGGVCGPSPPCITTVSVNESLLTPLNLEIDPNAQCVKQEEKEQIKSLNSRFAAFIDKVRFLEQQNKLLETKWQFYQNQRCCESNLEPLFSGYIETLRREAECVEADSGRLASELNHVQEVLEGYKKKYEEEVALRATAENEFVVLKKDVDCAYLRKSDLEANVEALVEESSFLRRLYEEEIRVLQAHISDTSVIVKMDNSRDLNMDCIIAEIKAQYDDVASRSRAEAESWYRSKCEEMKATVIRHGETLRRTKEEINELNRMIQRLTAEIENAKCQRAKLEAAVAEAEQQGEAALSDARCKLAELEGALQKAKQDMACLLKEYQEVMNSKLGLDIEIATYRRLLEGEEHRLCEGVGSVNVCVSSSRGGVSCGGLSYSTTPGRQITSGPSAIGGSITVVAPDSCAPCQPRSSSFSCGSSRSVRFA

SEQ ID NO: 50709 - protein, 295 aa, Homo sapiens
MVFKVQFLSSRPSLSHTQDVDCAYLRKSDLEANVEALVEESSFLRRLYEEEIRVLQAHISDTSVIVKMDNSRDLNMDCIIAEIKAQYDDVASRSRAEAESWYRSKCEEMKATVIRHGETLRRTKEEINELNRMIQRLTAEIENAKCQRAKLEAAVAEAEQQGEAALSDARCKLAELEGALQKAKQDMACLLKEYQEVMNSKLGLDIEIATYRRLLEGEEHRLCEGVGSVNVCVSSSRGGVSCGGLSYSTTPGRQITSGPSAIGGSITVVAPDSCAPCQPRSSSFSCGSSRSVRFA

SEQ ID NO: 50710 - protein, 486 aa, Homo sapiens
MTCGSYCGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFEGYIETLRREAECVEADSGRLASELNHVQEVLEGYKKKYEEEVSLRATAENEFVALKKDVDCAYLRKSDLEANVEALIQEIDFLRRLYEEEIRVLQSHISDTSVVVKLDNSRDLNMDCIIAEIKAQYDDIVTRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGVGSVNVCVSSSRGGVVCGDLCASTTAPVVSTRVSSVPSNSNVVVGTTNACAPSARVGVCGGSCKRC

SEQ ID NO: 50711 - protein, 623 aa, Homo sapiens
MSCRQFSSSYLSRSGGGGGGGLGSGGSIRSSYSRFSSSGGGGGGGRFSSSSGYGGGSSRVCGRGGGGSFGYSYGGGSGGGFSASSLGGGFGGGSRGFGGASGGGYSSSGGFGGGFGGGSGGGFGGGYGSGFGGFGGFGGGAGGGDGGILTANEKSTMQELNSRLASYLDKVQALEEANNDLENKIQDWYDKKGPAAIQKNYSPYYNTIDDLKDQIVDLTVGNNKTLLDIDNTRMTLDDFRIKFEMEQNLRQGVDADINGLRQVLDNLTMEKSDLEMQYETLQEELMALKKNHKEEMSQLTGQNSGDVNVEINVAPGKDLTKTLNDMRQEYEQLIAKNRKDIENQYETQITQIEHEVSSSGQEVQSSAKEVTQLRHGVQELEIELQSQLSKKAALEKSLEDTKNRYCGQLQMIQEQISNLEAQITDVRQEIECQNQEYSLLLSIKMRLEKEIETYHNLLEGGQEDFESSGAGKIGLGGRGGSGGSYGRGSRGGSGGSYGGGGSGGGYGGGSGSRGGSGGSYGGGSGSGGGSGGGYGGGSGGGHSGGSGGGHSGGSGGNYGGGSGSGGGSGGGYGGGSGSRGGSGGSHGGGSGFGGESGGSYGGGEEASGSGGGYGGGSGKSSHS

SEQ ID NO: 50712 - protein, 177 aa, Homo sapiens
MACCQTSFCGFPSCSTSGTCGSSCCQPSCCETSSCQPRCCETSCCQPSCCQTSFCGFPSFSTGGTCDSSCCQPSCCETSCCQPSCYQTSSCGTGCGIGGGIGYGQEGSSGAVSTRIRWCRPDCRVEGTCLPPCCVVSCTPPSCCQLHHAEASCCRPSYCGQSCCRPVCCCYCSEPTC

SEQ ID NO: 50713 - protein, 167 aa, Homo sapiens
MACCQTSFCGFPSCSTSGTCGSSCCQPRCCETSCCQPSCCQTSFCGFPSFSTGGTCDSSCCQPSCCETSCCQPSCYQTSSCGTGCGIGGGIGYGQEGSSGAVSTRIRWCRPDCRVEGTCLPPCCVVSCTPPSCCQLHHAEASCCRPSYCGQSCCRPVCCCYCSEPTC

SEQ ID NO: 50714 - protein, 163 aa, Homo sapiens
MSFNCSTRNCSSRPIGGRCIVPVAQVTTTSTTDADCLGGICLPSSFQTGSWLLDHCQETCCEPTACQPTCYRRTSCVSNPCQVTCSRQTTCISNPCSTTYSRPLTFVSSGCQPLGGISSVCQPVGGISTVCQPVGGVSTVCQPACGVSRTYQQSCVSSCRRTC

SEQ ID NO: 50715 - protein, 167 aa, Homo sapiens
MTCCQTSFCGYPSCSTSGTCGSSCCQPSCCETSCCQPSCCQTSFCGFPSFSTSGTCSSSCCQPSCCETSCCQPSCCQTSSCGTGCGIGGGIGYGQEGSSGAVSTRIRWCRPDCRVEGTCLPPCCVVSCTPPTCCQLHHAEASCCRPSYCGQSCCRPVCCCYSCEPTC

SEQ ID NO: 50716 - protein, 121 aa, Homo sapiens
MASCSTSGTCGSSCCQPSCCETSCCQPSCCQTSSCGTGCGIGGGIGYGQEGSGGSVSTRIRWCHPDCHVEGTCLPPCYLVSCTPPSCCQLHHAEASCCRPSYCGQSCCRPACCCHCCEPTC

SEQ ID NO: 50717 - protein, 278 aa, Homo sapiens
MGCCGCSGGCGSSCGGCGSGCGGCGSGCGGCGSGCGGSGSSCCVPVCCCKPVCCRVPTCSCSSCGKGGCGSSGGSKGGCGSCGGCKGGCGSCGGSKGGCGSCGGSKGGCGSCGGSKGGCGSGCGGCGSSCCVPVCCCKPMCCCVPACSCSSCGKGGCGSCGCSKGACGSCGGSKGGCGSCGGCKGGCGSCGGSKGGCGSGCGGCGSGCGVPVCCCSCSSCGSCAGSKGGCGSSCSQCSCCKPCCCSSGCGSSCCQSSCCKPCCSQSSCCVPVCCQCKI

SEQ ID NO: 50718 - protein, 169 aa, Homo sapiens
MGCCGCSGGCGSSCGGCDSSCGSCGSGCRGCGPSCCAPVYCCKPVCCCVPACSCSSCGKRGCGSCGGSKGGCGSCGCSQCSCCKPCCCSSGCGSSCCQCSCCKPYCSQCSCCKPCCSSSGRGSSCCQSSCCKPCCSSSGCGSSCCQSSCCKPCCSQSRCCVPVCYQCKI

SEQ ID NO: 50719 - protein, 579 aa, Homo sapiens
MCDQQQIQCRLPLQQCCVKGPSFCSSQSPFAQSQVVVQAPCEMQIVDCPASCPVQVCQVSDQAPCQSQTTQVKCQSKTKQVKGQAQCQSKTTQVKGQAASQSQTSSVQSQAPCQSEVSYVQCEASQPVQTCFVECAPVCYTETCYVECPVQNYVPCPAPQPVQMYRGRPAVCQPQGRFSTQCQYQGSYSSCGPQFQSRATCNNYTPQFQLRPSYSSCFPQYRSRTSFSPCVPQCQTQGSYGSFTEQHRSRSTSRCLPPPRRLQLFPRSCSPPRRFEPCSSSYLPLRPSEGFPNYCTPPRRSEPIYNSRCPRRPISSCSQRRGPKCRIEISSPCCPRQVPPQRCPVEIPPIRRRSQSCGPQPSWGASCPELRPHVEPRPLPSFCPPRRLDQCPESPLQRCPPPAPRPRLRPEPCISLEPRPRPLPRQLSEPCLYPEPLPALRPTPRPVPLPRPGQCEIPEPRPCLQPCEHPEPCPRPEPIPLPAPCPSPEPCRETWRSPSPCWGPNPVPYPGDLGCHESSPHRLDTEAPYCGPSSYNQGQESGAGCGPGDVFPERRGQDGHGDQGNAFAGVKGEAKSAYF

SEQ ID NO: 50720 - protein, 352 aa, Homo sapiens
MAGTICFIMWVLFITDTVWSRSVRQVYEVHDSDDWTIHDFECPMECFCPPSFPTALYCENRGLKEIPAIPSRIWYLYLQNNLIETIPEKPFENATQLRWINLNKNKITNYGIEKGALSQLKKLLFLFLEDNELEEVPSPLPRSLEQLQLARNKVSRIPQGTFSNLENLTLLDLQNNKLVDNAFQRDTFKGLKNLMQLNMAKNALRNMPPRLPANTMQLFLDNNSIEGIPENYFNVIPKVAFLRLNHNKLSDEGLPSRGFDVSSILDLQLSHNQLTKVPRISAHLQHLHLDHNKIKSVNVSVICPSPSMLPAERDSFSYGPHLRYLRLDGNEIKPPIPMALMTCFRLLQAVII

SEQ ID NO: 50721 - protein, 298 aa, Homo sapiens
MEEKQILCVGLVVLDVISLVDKYPKEDSEIRCLSQRWQRGGNASNSCTVLSLLGAPCAFMGSMAPGHVADFLVADFRRRGVDVSQVAWQSKGDTPSSCCIINNSNGNRTIVLHDTSLPDVSATDFEKVDLTQFKWIHIEGRNASEQVKMLQRIDAHNTRQPPEQKIRVSVEVEKPREELFQLFGYGDVVFVSKDVAKHLGFQSAEEALRGLYGRVRKGAVLVCAWAEEGADALGPDGKLLHSDAFPPPRVVDTLGAGDTFNASVIFSLSQGRSVQEALRFGCQVAGKKCGLQGFDGIV

SEQ ID NO: 50722 - protein, 298 aa, Homo sapiens
MEEKQILCVGLVVLDVISLVDKYPKEDSEIRCLSQRWQRGGNASNSCTVLSLLGAPCAFMGSMAPGHVADFVLDDLRRYSVDLRYTVFQTTGSVPIATVIINEASGSRTILYYDRSLPDVSATDFEKVDLTQFKWIHIEGRNASEQVKMLQRIDAHNTRQPPEQKIRVSVEVEKPREELFQLFGYGDVVFVSKDVAKHLGFQSAEEALRGLYGRVRKGAVLVCAWAEEGADALGPDGKLLHSDAFPPPRVVDTLGAGDTFNASVIFSLSQGRSVQEALRFGCQVAGKKCGLQGFDGIV

SEQ ID NO: 50723 - protein, 346 aa, Homo sapiens
MEEKYLPELMAEKDSLDPSFTHALRLVNQEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYDYDDGYGTAYDEQSYDSYDNSYSTPAQSGADYYDYGHGLSEETYDSYGQEEWTNSRHKAPSARTAKGVYRDQPYGRY

SEQ ID NO: 50724 - protein, 164 aa, Homo sapiens
MDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGLEMLERVRSQPLTNDDLVTSISVPPYTGDLSLAPRISGTVCLSVPQPSPYQVIGCSGFHLSSLYP

SEQ ID NO: 50725 - protein, 237 aa, Homo sapiens
MLSAFQRLFRVLFVIETVSEYGVLIFIYGWPFLQTLAMLLIGTVSFHLWIRRNRERNSRSGKTRCRSKRSEQSMDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGLEMLERVRSQPLTNDDLVTSISVPPYTGDLSLAPRISGTVCLSVPQPSPYQVIGCSGFHLSSLYP

SEQ ID NO: 50726 - protein, 98 aa, Homo sapiens
MDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHAR

SEQ ID NO: 50727 - protein, 710 aa, Homo sapiens
MSDYSTGGPPPGPPPPAGGGGGAGGAGGGPPPGPPGAGDRGGGGPGGGGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGFLAPPTVFQPLLSSALAQLPRPRPSPLPGLVCCLFICSRGD

SEQ ID NO: 50728 - protein, 711 aa, Homo sapiens
MSDYSTGGPPPGPPPPAGGGGGAGGAGGGPPPGPPGAGDRGGGGPGGGGPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDLLQSLRSGPPGPPGGPGMPPGGRGRGRGQGNWGPPGGEMTFSIPTHKCGLVIGRGGENVKAINQQTGAFVEISRQLPPNGDPNFKLFIIRGSPQQIDHAKQLIEEKIEGPLCPVGPGPGGPGPAGPMGPFNPGPFNQGPPGAPPHAGGPPPHQYPPQGWGNTYPQWQPPAPHDPSKAAAAAADPNAAWAAYYSHYYQQPPGPVPGPAPAPAAPPAQGEPPQPPPTGQSDYTKAWEEYYKKIGQQPQQPGAPPQQDYTKAWEEYYKKQAQVATGGGPGAPPGSQPDYSAAWAEYYRQQAAYYGQTPGPGGPQPPPTQQGQQQAQ

SEQ ID NO: 50729 - protein, 364 aa, Homo sapiens
MSDYSPGGGSAGGPSQPPGGGGPGIRKDAFADAVQRARQIAAKIGGDAATTVNNSTPDFGFGGQKRQLEDGDQPESKKLASQGDSISSQLGPIHPPPRTSMTEEYRVPDGMVGLIIGRGGEQINKIQQDSGCKVQISPDSGGLPERSVSLTGAPESVQKAKMMLDDIVSRGRGGPPGQFHDNANGGQNGTVQEIMIPAGKAGLVIGKGGETIKQLQERAGVKMILIQDGSQNTNVDKPLRIIGDPYKVQQACEMVMDILRERDQGGFGDRNEYGSRIGGGIDVPVPRHSVGVVIGRSGEMIKKIQNDAGVRIQFKQDDGTGPEKIAHIMGPPDRCEHAARIINDPSSSSFLLPTPGHRPSCLSG

SEQ ID NO: 50730 - protein, 84 aa, Homo sapiens
MDDDAAPRVEGVPVAVHKHALHDGLRQVAGPGAAAAHLPRWPPPQLAASRREAPPLSQRPHRTQGAGSPPETNEKLTNPQVKEK

SEQ ID NO: 50731 - protein, 273 aa, Homo sapiens
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKMLL

SEQ ID NO: 50732 - protein, 422 aa, Homo sapiens
MGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 50733 - protein, 349 aa, Homo sapiens
MSLMVVSMACVGLFLVQRAGPHMGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 50734 - protein, 444 aa, Homo sapiens
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 50735 - protein, 455 aa, Homo sapiens
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 50736 - protein, 444 aa, Homo sapiens; identical to SEQ ID NO: 50734

SEQ ID NO: 50737 - protein, 427 aa, Homo sapiens
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 50738 - protein, 455 aa, Homo sapiens
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 50739 - protein, 348 aa, Homo sapiens
MSLMVVSMACVGFFLLQGAWPHEGVHRKPSLLAHPGRLVKSEETVILQCWSDVRFEHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHECRFSAGPKVNGTFQADFPLGPATHGGTYRCFGSFRDSPYEWSNSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 50740 - protein, 375 aa, Homo sapiens
MSLMVVSMACVGFFLLQGAWPHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVNGTFQADFPLGPATHGGTYTCFGSLHDSPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGI

SEQ ID NO: 50741 - protein, 375 aa, Homo sapiens
MSLMVISMACVGFFLLQGAWTHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVNGTFQADFPLGPATHGGTYTCFGSLHDSPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGI

SEQ ID NO: 50742 - protein, 387 aa, Homo sapiens
MSLMVVSMACVGLFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHKEWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKNAAVMDQEPAGNRSEQRGF

SEQ ID NO: 50743 - protein, 382 aa, Homo sapiens
MLLMVVSMACVGLFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHKEWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKKCCCNGPRACREQK

SEQ ID NO: 50744 - protein, 397 aa, Homo sapiens
MSLMVVSMACVGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKVSLTKQRPENSGPCAEAGWEHADAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 50745 - protein, 342 aa, Homo sapiens
MSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 50746 - protein, 360 aa, Homo sapiens
MSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 50747 - protein, 377 aa, Homo sapiens
MSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKNAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 50748 - protein, 410 aa, Homo sapiens
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLIGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 50749 - protein, 348 aa, Homo sapiens
MSLLVVSMACVGFFLLQGAWPHEGVHRKPSLLAHPGRLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQLGPTVLAGENVTLSCSSRSSYDMYHLSREGEAHERRLPAGPKVNGTFQADFPLGPATHGGTYRCFGSFHDSPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 50750 - protein, 341 aa, Homo sapiens
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEP

SEQ ID NO: 50751 - protein, 348 aa, Homo sapiens
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 50752 - protein, 342 aa, Homo sapiens
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 50753 - protein, 325 aa, Homo sapiens
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 50754 - protein, 397 aa, Homo sapiens
MSLMVVSMACVGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKVSLTKQRPENSGPCAEAGWEHADAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 50755 - protein, 230 aa, Homo sapiens
MSMSPTVIILACLGFFLDQSVWAHVGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 50756 - protein, 225 aa, Homo sapiens
MDQQAIYAELNLPTDSGPESSSPSSLPRDVCQGSPWHQFALKLSCAGIILLVLVVTGLSVSVTSLIQKSSIEKCSVDIQQSRNKTTERPGLLNCPIYWQQLREKCLLFSHTVNPWNNSLADCSTKESSLLLIRDKDELIHTQNLIRDKAILFWIGLNFSLSEKNWKWINGSFLNSNDLEIRGDAKENSCISISQTSVYSEYCSTEIRWICQKELTPVRNKVYPDS

SEQ ID NO: 50757 - protein, 215 aa, Homo sapiens
MDNQGVIYSDLNLPPNPKRQQRKPKGNKNSILATEQEITYAELNLQKASQDFQGNDKTYHCKDLPSAPEKLIVGILGIICLILMASVVTIVVIPSRHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSIIYHCKHKL

SEQ ID NO: 50758 - protein, 233 aa, Homo sapiens
MDNQGVIYSDLNLPPNPKRQQRKPKGNKNSILATEQEITYAELNLQKASQDFQGNDKTYHCKDLPSAPEKLIVGILGIICLILMASVVTIVVIPSTLIQRHNNSSLNTRTQKARHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSIIYHCKHKL

SEQ ID NO: 50759 - protein, 215 aa, Homo sapiens; identical to SEQ ID NO: 50757

SEQ ID NO: 50760 - protein, 233 aa, Homo sapiens; identical to SEQ ID NO: 50758

SEQ ID NO: 50761 - protein, 231 aa, Homo sapiens
MNKQRGTFSEVSLAQDPKRQQRKPKGNKSSISGTEQEIFQVELNLQNPSLNHQGIDKIYDCQGLLPPPEKLTAEVLGIICIVLMATVLKTIVLIPFLEQNNSSPNTRTQKTRHCGHCPEEWITYSNSCYYIGKERRTWEESLLACTSKNSSLLSIDNEEEMKFLASILPSSWIGVFRNSSHHPWVTINGLAFKHKIKDSDNAELNCAVLQVNRLKSAQCGSSMIYHCKHKL

SEQ ID NO: 50762 - protein, 231 aa, Homo sapiens
MNKQRGTFSEVSLAQDPKRQQRKPKGNKSSISGTEQEIFQVELNLQNPSLNHQGIDKIYDCQGLLPPPEKLTAEVLGIICIVLMATVLKTIVLIPFLEQNNFSPNTRTQKARHCGHCPEEWITYSNSCYYIGKERRTWEESLLACTSKNSSLLSIDNEEEMKFLASILPSSWIGVFRNSSHHPWVTINGLAFKHKIKDSDNAELNCAVLQVNRLKSAQCGSSMIYHCKHKL

SEQ ID NO: 50763 - protein, 124 aa, Homo sapiens
MIPTRHCGHCPEEWITYSNSCYYIGKERRTWEESLLACTSKNSSLLSIDNEEEMKFLASILPSSWIGVFRNSSHHPWVTINGLAFKHKIKDSDNAELNCAVLQVNRLKSAQCGSSMIYHCKHKL

SEQ ID NO: 50764 - protein, 257 aa, Homo sapiens
MSKQRGTFSEVSLAQDPKWQQRKPKGNKSSISGTEQEIFQVELNLQNASLNHQGIDKIYDCQGLLPPPEKLTAEVLGIICIVLMATVLKTIVLIPFLEQNNSSPNARTQKARHCGHCPEEWITYSNSCYYIGKERRTWEESLQACASKNSSSLLCIDNEEEMKFLASILPSSWIGVFRNSSHHPWVTINGLAFKHEIKDSDHAERNCAMLHVRGLISDQCGSSRIIVSISFRIKALELAVHQIKFYICSNRNDIMIA

SEQ ID NO: 50765 - protein, 240 aa, Homo sapiens
MSKQRGTFSEVSLAQDPKWQQRKPKGNKSSISGTEQEIFQVELNLQNASLNHQGIDKIYDCQGLLPPPEKLTAEVLGIICIVLMATVLKTIVLIPFLEQNNSSPNTRTQKTRHCGHCPEEWITYSNSCYYIGKERRTWEESLQACASKNSSSLLCIDNEEEMKFLASILPSSWIGVFRNSSHHPWVTINGLAFKHEIKDSDHAERNCAMLHVRGLISDQCGSSRIIRRGFIMLTRLVLNS

SEQ ID NO: 50766 - protein, 240 aa, Homo sapiens
MSKQRGTFSEVSLAQDPKWQQRKPKGNKSSISGTEQEIFQVELNLQNASLNHQGIDKIYDCQGLLPPPEKLTAEVLGIICIVLMATVLKTIVLIPFLEQNNSSPNARTQKARHCGHCPEEWITYSNSCYYIGKERRTWEESLQACASKNSSSLLCIDNEEEMKFLASILPSSWIGVFRNSSHHPWVTINGLAFKHEIKDSDHAERNCAMLHVRGLISDQCGSSRIIRRGFIMLTRLVLNS

SEQ ID NO: 50767 - protein, 158 aa, Homo sapiens
MNKQRGTYSEVSLAQDPKRQQRKLKGNKISISGTKQEIFQVELNLQNASSDHQGNDKTYHCKGLLPPPEKLTAEVLGIICIVLMATVLKTIVLIPCIGVLEQNNFSLNRRMQKARHCGHCPEEWITYSNSCYYIGKERRTWEERVCWPVLRRTLICFL

SEQ ID NO: 50768 - protein, 179 aa, Homo sapiens
MAVFKTTLWRLISGTLGIICLSLMSTLGILLKNSFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 50769 - protein, 148 aa, Homo sapiens
MAAFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 50770 - protein, 179 aa, Homo sapiens; identical to SEQ ID NO: 50768

SEQ ID NO: 50771 - protein, 180 aa, Homo sapiens
MAVFKTTLWRLISGTLGIICLSLMSTLGILLKNSFTKLSIEPAFTPGPNIELQKDSDCCSCQEKWVGYRCNCYFISSEQKTWNESRHLCASQKSSLLQLQNTDELQDFMSSSQQFYWIGLSYSEEHTAWLWENGSALSQYLFPSFETFNTKNCIAYNPNGNALDESCEDKNRYICKQQLI

SEQ ID NO: 50772 - protein, 51 aa, Homo sapiens
SALSQYLFPSFETFNTKNCIAYNPNGNALDESCEDKNRYIYKVLLCCPGWS

SEQ ID NO: 50773 - protein, 139 aa, Homo sapiens
MAAFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKN

SEQ ID NO: 50774 - protein, 232 aa, Homo sapiens
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVLCQSEWLKYQGKCCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 50775 - protein, 182 aa, Homo sapiens
MQDEERYMTLNVQSKKRSSAQTSQLTFKDYSVTLHWYKILLGISGTVNGILTLTLISLILLVLCQSEWLKYQGKCCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 50776 - protein, 64 aa, Homo sapiens
MQDEERYMTLNVQSKKRSSAQTSQLTFKDYSVTLHWYKILLGISGTVNGILTLTLISLILLDSS

SEQ ID NO: 50777 - protein, 195 aa, Homo sapiens
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKCPFADQALF

SEQ ID NO: 50778 - protein, 189 aa, Homo sapiens
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKVRL

SEQ ID NO: 50779 - protein, 216 aa, Homo sapiens
MGWIRGRRSRHSWEMSEFHNYNLDLKKSDFSTRWQKQRCPVVKSKCRENASPFFFCCFIAVAMGIRFIIMVTIWSAVFLNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 50780 - protein, 80 aa, Homo sapiens
MGWIRGRRSRHSWEMSEFHNYNLDLKKSDFSTRWQKQRCPVVKSKCRENASPFFFCCFIAVAMGIRFIIMVTIWSAVFLN

SEQ ID NO: 50781 - protein, 216 aa, Homo sapiens; identical to SEQ ID NO: 50779

SEQ ID NO: 50782 - protein, 178 aa, Homo sapiens
MDRPGPGSARPGRTVHVWGYRVEWKVRNGRKLQPSEWAGRGDLGGFKRRWKDTRATVGTTFRRRSRVSLVGELSKFPLPSDSSGGKSSSSFARGALAWCRQRNPNPSCAAAETGARTSLPKERCRGWRLGNWLHKHPHPNTCPRLPACWLPPILTERGERVPKLVPLLACYPKSKPKD

SEQ ID NO: 50783 - protein, 633 aa, Homo sapiens
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEKGTLETKDPTNGYYKVRGVSPPASPDSRVTSFQWKSPGISNLP

SEQ ID NO: 50784 - protein, 219 aa, Homo sapiens
MLRMRVPALLVLLFCFRGRAGPSPHFLQQPEDLVVLLGEGGAQASLGRRASASFSEQKNLMRIPGSSDGSSSRGPEEEETGSREDRGPIVHTDHSDLVLEEKGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 50785 - protein, 688 aa, Homo sapiens
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEKGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 50786 - protein, 583 aa, Homo sapiens
MLRMRVPALLVLLFCFRGRAGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEKGTLETKDPTNGYYKVRGVSPPASPDSRVTSFQWKSPGISNLP

SEQ ID NO: 50787 - protein, 708 aa, Homo sapiens
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEKGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 50788 - protein, 245 aa, Homo sapiens
MAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 50789 - protein, 778 aa, Homo sapiens
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 50790 - protein, 600 aa, Homo sapiens
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMAVIIGVAVGAGVAFLVLMATIVAFCCARSQRSTGGRSGISGRGTEKKARLRLPRRASKQECNEQGS

SEQ ID NO: 50791 - protein, 766 aa, Homo sapiens
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQESVPMAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 50792 - protein, 393 aa, Homo sapiens
MGKSDFLTPKAIANRIKSKGLQKLRWYCQMCQKQCRDENGFKCHCMSESHQRQLLLASENPQQFMDYFSEEFRNDFLELLRRRFGTKRVHNNIVYNEYISHREHIHMNATQWETLTDFTKWLGREGLCKVDETPKGWYIQYIDRDPETIRRQLELEKKKKQDLDDEEKTAKFIEEQVRRGLEGKEQEVPTFTELSRENDEEKVTFNLSKGACSSSGATSSKSSTLGPSALKTIGSSASVKRKESSQSSTQSKEKKKKKSALDEIMEIEEEKKRTARTDYWLQPEIIVKIITKKLGEKYHKKKAIVKEVIDKYTAVVKMIDSGDKLKLDQTHLETVIPAPGKRILVLNGGYRGNEGTLESINEKTFSATIVIETGPLKGRRVEGIQYEDISKLA

SEQ ID NO: 50793 - protein, 374 aa, Homo sapiens
MGKSDFLTPKAIANRIKSKGLQKLRWYCQMCQKQCRDENGFKCHCMSESHQRQLLLASENPQQFMDYFSEEFRNDFLELLRRRFGTKRVHNNIVYNEYISHREHIHMNATQWETLTDFTKWLGREGLCKVDETPKGWYIQYIDRDPETIRRQLELEKKKKQDLDDEEKTAKFIEEQVRRGLEGKEQEVPTFTELSRENDEEKVTFNLSKGACSSSGATSSKSSTLGPSALKTIGSSASVKRKESSQSSTQSKEKKKKKSALDEIMEIEEEKKRTARTDYWLQPEIIVKIITKKLGEKYHKKKAIVKEVIDKYTAVVKMIDSGDKLKLDQTHLETVIPAPGKRILVLNGGYRGNEGTLESINEKTFSATIVIETV

SEQ ID NO: 50794 - protein, 288 aa, Homo sapiens
MNATQWETLTDFTKWLGREGLCKVDETPKGWYIQYIDRDPETIRRQLELEKKKKQDLDDEEKTAKFIEEQVRRGLEGKEQEVPTFTELSRENDEEKVTFNLSKGACSSSGATSSKSSTLGPSALKTIGSSASVKRKESSQSSTQSKEKKKKKSALDEIMEIEEEKKRTARTDYWLQPEIIVKIITKKLGEKYHKKKAIVKEVIDKYTAVVKMIDSGDKLKLDQTHLETVIPAPGKRILVLNGGYRGNEGTLESINEKTFSATIVIETVSLFTQRQKFQNALKMCHSFF

SEQ ID NO: 50795 - protein, 786 aa, Homo sapiens
MNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPPSRKVFQLLPSFPTLTRSKSHESQLGNRIDDVSSMRFDLSHGSPQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPVPSAGHCWKCLLIAESLKENAFNISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSADINSSKVVPRFERFGLGVLESSNPKM

SEQ ID NO: 50796 - protein, 923 aa, Homo sapiens [sequence omitted]

SEQ ID NO: 50797 - protein, 762 aa, Homo sapiens
MNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPPSRKVFQLLPSFPTLTRSKSHESQLGNRIDDVSSMRFDLSHGSPQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPVPSAGHCWKCLLIAESLKENAFNISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSAEL

SEQ ID NO: 50798 - protein, 124 aa, Homo sapiens
MQADLEIPRDLTLDALLEMNEAKVKETLRRCGASGDECGRLQYALTCLRKVTGLGTWGLPPSPLPGLVPLGLWPSLWWVMERGKRGPGFLGQPGKARVGCSQPPEKLSQGPQGSGSWWVWPGRI

SEQ ID NO: 50799 - protein, 613 aa, Homo sapiens
  MOD_RES (1)..(1): Any amino acid
XHSFITPPTTPQLRRHTKLKPPRTPPPPSRKVFQLLPSFPTLTRSKSHESQLGNRIDDVSSMRFDLSHGSPQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPDISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSAEL

SEQ ID NO: 50800 - protein, 877 aa, Homo sapiens
MDRAALRAAAMGEKKEGGGGGDAAAAEGGAGAAASRALQQCGQLQKLIDISIGSLRGLRTKCAVSNDLTQQEIRTLEAKLVRYICKQRQCKLSVAPGERTPELNSYPRFSDWLYTFNVRPEVVQEIPRDLTLDALLEMNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPPSRKVFQLLPSFPTLTRSKSHESQLGNRIDDVSSMRFDLSHGSPQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPDISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSAEL

SEQ ID NO: 50801 - protein, 436 aa, Homo sapiens
MYNKKAKMEPNASESAIPARRQRQPRAKKKSKPLNLKIHSSVGSCENIPSQQRSPLLSERSLRSFFVGHAPFLPSTPPVHTEANFSANTLSVPRWSPQIPRRDLGNSIKHRFSTKYWMSQTCTVCGKGMLFGLKCKNCKLKCHNKCTKEAPPCHLLIIHRGDPARLVRTESVPCDINNPLRKPPRYSDLHISQTLPKTNKINKDHIPVPYQPDSSSNPSSTTSSTPSSPAPPLPPSATPPSPLHPSPQCTRQQKNFNLPASHYYKYKQQFIFPDVVPVPETPTRAPQVILHPVTSNPILEGNPLLQIEVEPTSENEEVHDEAEESEDDFEEMNLSLLSARSFPRKASQTSIFLQEWDIPFEQLEIGELIGKGRFGQVYHGRWHGEVAIRLIDIERDNEDQLKAFKREVMAYRQTRHENVVLFMGACMSPPHLAIIT

SEQ ID NO: 50802 - protein, 950 aa, Homo sapiens [sequence omitted]

SEQ ID NO: 50803 - protein, 921 aa, Homo sapiens
MIDLSISNLEGLRTKCATSNDLTQKEIRTLESKLVKYFSRQLSCKKKVALQERNAELDGFPQLRHWFRIVDVRKEVLEEISPGQLSLEDLLEMTDEQVCETVEKYGANREECARLNASLSCLRNVHMSGGNLSKQDWTIQWPTTETGKENNPVCPPEPTPWIRTHLSQSPRVPSKCVQHYCHTSPTPGAPVYTHVDRLTVDAYPGLCPPPPLESGHRSLPPSPRQRHAVRTPPRTPNIVTTVTPPGTPPMRKKNKLKPPGTPPPSSRKLIHLIPGFTALHRSKSHEFQLGHRVDEAHTPKAKKKSKPLNLKIHSSVGSCENIPSQQRSPLLSERSLRSFFVGHAPFLPSTPPVHTEANFSANTLSVPRWSPQIPRRDLGNSIKHRFSTKYWMSQTCTVCGKGMLFGLKCKNCKLKCHNKCTKEAPPCHLLIIHRGDPARLVRTESVPCDINNPLRKPPRYSDLHISQTLPKTNKINKDHIPVPYQPDSSSNPSSTTSSTPSSPAPPLPPSATPPSPLHPSPQCTRQQKNFNLPASHYYKYKQQFIFPDVVPVPETPTRAPQVILHPVTSNPILEGNPLLQIEVEPTSENEEVHDEAEESEDDFEEMNLSLLSARSFPRKASQTSIFLQEWDIPFEQLEIGELIGKGRFGQVYHGRWHGEVAIRLIDIERDNEDQLKAFKREVMAYRQTRHENVVLFMGACMSPPHLAIITSLCKGRTLYSVVRDAKIVLDVNKTRQIAQEIVKGMGYLHAKGILHKDLKSKNVFYDNGKVVITDFGLFSISGVLQAGRREDKLRIQNGWLCHLAPEIIRQLSPDTEEDKLPFSKHSDVFALGTIWYELHAREWPFKTQPAEAIIWQMGTGMKPNLSQIGMGKEISDILLFCWAFEQEERPTFTKLMDMLEKLPKRNRRLSHPGHFWKSAEL

SEQ ID NO: 50804 - protein, 414 aa, Homo sapiens
RAKKKSKPLNLKIHSSVGSCENIPSQQRSPLLSERSLRSFFVGHAPFLPSTPPVHTEANFSANTLSVPRWSPQIPRRDLGNSIKHRFSTKYWMSQTCTVCGKGMLFGLKCKNCKLKCHNKCTKEAPPCHLLIIHRGDPARLVRTESVPCDINNPLRKPPRYSDLHISQTLPKTNKINKDHIPVPYQPDSSSNPSSTTSSTPSSPAPPLPPSATPPSPLHPSPQCTRQQKNFNLPASHYYKYKQQFIFPDVVPVPETPTRAPQVILHPVTSNPILEGNPLLQIEVEPTSENEEVHDEAEESEDDFEEMNLSLLSARSFPRKASQTSIFLQEWDIPFEQLEIGELIGKGRFGQVYHGRWHGEVAIRLIDIERDNEDQLKAFKREVMAYRQTRHENVVLFMGACMSPPHLAIITRPV

SEQ ID NO: 50805 - protein, 1306 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNDLREKNWEAMEALASTEKMLQDKVNKTSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 50806 - protein, 1357 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNDLREKNWEAMEALASTEKMLQDKVNKTSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKDLLTELQKKLDDSYSEAVRQNEELNLLKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 50807 - protein, 1306 aa, Homo sapiens; identical to SEQ ID NO: 50805

SEQ ID NO: 50808 - protein, 1357 aa, Homo sapiens; identical to SEQ ID NO: 50806

SEQ ID NO: 50809 - protein, 1306 aa, Homo sapiens; identical to SEQ ID NO: 50805

SEQ ID NO: 50810 - protein, 1357 aa, Homo sapiens; identical to SEQ ID NO: 50806

SEQ ID NO: 50811 - protein, 1300 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 50812 - protein, 1357 aa, Homo sapiens; identical to SEQ ID NO: 50806

SEQ ID NO: 50813 - protein, 75 aa, Homo sapiens
MEFYESAYFIVLIPSIVITVIFLFFWLFMKETLYDEVLAKQKREQKLIPTKTDKKKAEKKKNKKKEIQNGNLHES

SEQ ID NO: 50814 - protein, 60 aa, Homo sapiens
MEFYESAYFIVLIPSIVITVIFLFFWLFMKETLYDEVLAKQKREQKLIPTKTDKKKAEKK

SEQ ID NO: 50815 - protein, 1056 aa, Homo sapiens
MASQPNSSAKKKEEKGKNIQVVVRCRPFNLAERKASAHSIVECDPVRKEVSVRTGGLADKSSRKTYTFDMVFGASTKQIDVYRSVVCPILDEVIMGYNCTIFAYGQTGTGKTFTMEGERSPNEEYTWEEDPLAGIIPRTLHQIFEKLTDNGTEFSVKVSLLEIYNEELFDLLNPSSDVSERLQMFDDPRNKRGVIIKGLEEITVHNKDEVYQILEKGAAKRTTAATLMNAYSSRSHSVFSVTIHMKETTIDGEELVKIGKLNLVDLAGSENIGRSGAVDKRAREAGNINQSLLTLGRVITALVERTPHVPYRESKLTRILQDSLGGRTRTSIIATISPASLNLEETLSTLEYAHRAKNILNKPEVNQKLTKKALIKEYTEEIERLKRDLAAAREKNGVYISEENFRVMSGKLTVQEEQIVELIEKIGAVEEELNRVTELFMDNKNELDQCKSDLQNKTQELETTQKHLQETKLQLVKEEYITSALESTEEKLHDAASKLLNTVEETTKDVSGLHSKLDRKKAVDQHNAEAQDIFGKNLNSLFNNMEELIKDGSSKQKAMLEVHKTLFGNLLSSSVSALDTITTVALGSLTSIPENVSTHVSQIFNMILKEQSLAAESKTVLQELINVLKTDLLSSLEMILSPTVVSILKINSQLKHIFKTSLTVADKIEDQKKELDGFLSILCNNLHELQENTICSLVESQKQCGNLTEDLKTIKQTHSQELCKLMNLWTERFCALEEKCENIQKPLSSVQENIQQKSKDIVNKMTFHSQKFCADSDGFSQELRNFNQEGTKLVEESVKHSDKLNGNLEKISQETEQRCESLNTRTVYFSEQWVSSLNEREQELHNLLEVVSQCCEASSSDITEKSDGRKAAHEKQHNIFLDQMTIDEDKLIAQNLELNETIKIGLTKLNCFLEQDLKLDIPTGTTPQRKSYLYPSTLVRTEPREHLLDQLKRKQPELLMMLNCSENNKEETIPDVDVEEAVLGQYTEEPLSQEPSVDAGVDCSSIGGVPFFQHKKSHGKDKENRGINTLERSKVEETTEHLVTKSRLPLRAQINL

SEQ ID NO: 50816 - protein, 1805 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQESMPPPQAHNPGCIVPSGSNGSSMPVEHNSKREKKIDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 50817 - protein, 1749 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQGGTTSR

SEQ ID NO: 50818 - protein, 1770 aa, Homo sapiens
MSDTKVKVAVRVRPMNRRELELNTKCVVEMEGNQTVLHPPPSNTKQGERRPSQVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 50819 - protein, 1770 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 50820 - protein, 1757 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 50821 - protein, 70 aa, Homo sapiens
MSDTKVKVAVRVRPMNRRELELNTKCVVEMEGNQTVLHPPPSNTKQGERLVTVAHISNSSTLGGQGKRIT

SEQ ID NO: 50822 - protein, 345 aa, Homo sapiens
MPKLLKSLFPVRDEKRGKRPSPLAHQAQPEMGPDVLVQTMGAPALKICDKPAKVPSPPPVIAVTAVTPAPEAQDGPPSPLSEASSGYFSHSVSTATLSDALGPGLDAAAPPGSMPTAPEAEPEAPISHPPPPTAVPAEEPPGPQQLVSPGRERPDLEAPAPGSPFRVRRVRASELRSFSRMLAGDPGCSPGAEGNAPAPGAGGQALASDSEEADEVPEWLREGEFVTVGAHKTGVVRYVGPADFQEGTWVGVELDLPSGKNDGSIGGKQYFRCNPGYGLLVRPSRVRRATGPVRRRSTGLRLGAPEARRSATLSGSATNLASLTAALAKADRSHKNPENRKSWAS

SEQ ID NO: 50823 - protein, 1826 aa, Homo sapiens
MGDSKVKVAVRIRPMNRRETDLHTKCVVDVDANKVILNPVNTNLSKGDARGQPKVFAYDHCFWSMDESVKEKYAGQDIVFKCLGENILQNAFDGYNACIFAYGQTGSGKSYTMMGTADQPGLIPRLCSGLFERTQKEENEEQSFKVEVSYMEIYNEKVRDLLDPKGSRQTLKVREHSVLGPYVDGLSKLAVTSYKDIESLMSEGNKSRTVAATNMNEESSRSHAVFKITLTHTLYDVKSGTSGEKVGKLSLVDLAGSERATKTGAAGDRLKEGSNINKSLTTLGLVISALADQSAGKNKNKFVPYRDSVLTWLLKDSLGGNSKTAMVATVSPAADNYDETLSTLRYADRAKHIVNHAVVNEDPNARIIRDLREEVEKLREQLTKAEAMKSPELKDRLEESEKLIQEMTVTWEEKLRKTEEIAQERQKQLESLGISLQSSGIKVGDDKCFLVNLNADPALNELLVYYLKEHTLIGSANSQDIQLCGMGILPEHCIIDITSEGQVMLTPQKNTRTFVNGSSVSSPIQLHHGDRILWGNNHFFRLNLPKKKKKAEREDEDQDPSMKNENSSEQLDVDGDSSSEVSSEVNFNYEYAQMEVTMKALGSNDPMQSILNSLEQQHEEEKRSALERQRLMYEHELEQLRRRLSPEKQNCRSMDRFSFHSPSAQQRLRQWAEEREATLNNSLMRLREQIVKANLLVREANYIAEELDKRTEYKVTLQIPASSLDANRKRGSLLSEPAIQVRRKGKGKQIWSLEKLDNRLLDMRDLYQEWKECEEDNPVIRSYFKRADPFYDEQENHSLIGVANVFLESLFYDVKLQYAVPIINQKGEVAGRLHVEVMRLSGDVGERIAGGDEVAEVSFEKETQENKLVCMVKILQATGLPQHLSHFVFCKYSFWDQQEPVIVAPEVDTSSSSVSKEPHCMVVFDHCNEFSVNITEDFIEHLSEGALAIEVYGHKINDPRKNPALWDLGIIQAKTRSLRDRWSEVTRKLEFWVQILEQNENGEYCPVEVISAKDVPTGGIFQLRQGQSRRVQVEVKSVQESGTLPLMEECILSVGIGCVKVRPLRAPRTHETFHEEEEDMDSYQDRDLERLRRKWLNALTKRQEYLDQQLQKLVSKRDKTEDDADREAQLLEMRLTLTEERNAVMVPSAGSGIPGAPAEWTPVPGMETHIPVIFLDLNADDFSSQDNLDDPEAGGWDATLTGEEEEEFFELQIVKQHDGEVKAEASWDSAVHGCPQLSRGTPVDERLFLIVRVTVQLSHPADMQLVLRKRICVNVHGRQGFAQSLLKKMSHRSSIPGCGVTFEIVSNIPEDAQGVEEREALARMAANVENPASADSEAYIEKYLRSVLAVENLLTLDRLRQEVAVKEQLTGKGKLSRRSISSPNVNRLSGSRQDLIPSYSLGSNKGRWESQQDVSQTTVSRGIAPAPALSVSPQNNHSPDPGLSNLAASYLNPVKSFVPQMPKLLKSLFPVRDEKRGKRPSPLAHQPVPRIMVQSASPDIRVTRMEEAQPEMGPDVLVQTMGAPALKICDKPAKVPSPPPVIAVTAVTPAPEAQDGPPSPLSEASSGYFSHSVSTATLSDALGPGLDAAAPPGSMPTAPEAEPEAPISHPPPPTAVPAEEPPGPQQLVSPGRERPDLEAPAPGSPFRVRRVRASELRSFSRMLAGDPGCSPGAEGNAPAPGAGGQALASDSEEADEVPEWLREGEFVTVGAHKTGVVRYVGPADFQEGTWVGVELDLPSGKNDGSIGGKQYFRCNPGYGLLVRPSRVRRATGPVRRRSTGLRLGAPEARRSATLSGSATNLASLTAALAKADRSHKNPENRKSWAS

SEQ ID NO: 50824 - protein, 1648 aa, Homo sapiens
MSLHSTHNRNNSGDILDIPSSQNSSSLNALTHSSRLKLHLKSDMSECENDDPLLRSAGKVRDINRTYVISASRKTADMPLTPNPVGRLALQRRTTRNKESSLLVSELEDTTEKTAETRLTLQRRAKTDSAEKWKTAEIDSVKMTLNVGGETENNGVSKESRTNVRIVNNAKNSFVASSVPLDEDPQVIEMMADKKYKETFSAPSRANENVALKYSSNRPPIASLSQTEVVRSGHLTTKPTQSKLDIKVLGTGNLYHRSIGKEIAKTSNKFGSLEKRTPTKCTTEHKLTTKCSLPQLKSPAPSILKNRMSNLQVKQRPKSSFLANKQERSAENTILPEEETVVQNTSAGKDPLKVENSQVTVAVRVRPFTKREKIEKASQVVFMSGKEITVEHPDTKQVYNFIYDVSFWSFDECHPHYASQTTVYEKLAAPLLERAFEGFNTCLFAYGQTGSGKSYTMMGFSEEPGIIPRFCEDLFSQVARKQTQEVSYHIEMSFFEVYNEKIHDLLVCKDENGQRKQPLRVREHPVYGPYVEALSMNIVSSYADIQSWLELGNKQRATAATGMNDKSSRSHSVFTLVMTQTKTEFVEGEEHDHRITSRINLIDLAGSERCSTAHTNGDRLKEGVSINKSLLTLGKVISALSEQANQRSVFIPYRESVLTWLLKESLGGNSKTAMIATISPAASNIEETLSTLRYANQARLIVNIAKVNEDMNAKLIRELKAEIAKLKAAQRNSRNIDPERYRLCRQEITSLRMKLHQQERDMAEMQRVWKEKFEQAEKRKLQETKELQKAGIMFQMDNHLPNLVNLNEDPQLSEMLLYMIKEGTTTVGKYKPNSSHDIQLSGVLIADDHCTIKNFGGTVSIIPVGEAKTYVNGKHILEITVLRHGDRVILGGDHYFRFNHPVEVQKGKRPSGRDTPISEGPKDFEFAKNELLMAQRSQLEAEIKEAQLKAKEEMMQGIQIAKEMAQQELSSQKAAYESKIKALEAELREESQRKKMQEINNQKANHKIEELEKAKQHLEQEIYVNKKRLEMETLATKQALEDHSIRHARILEALETEKQKIAKEVQILQQNRNNRDKTFTVQTTWSSMKLSMMIQEANAISSKLKTYYVFGRHDISDKSSSDTSIRVRNLKLGISTFWSLEKFESKLAAMKELYESNGSNRGEDAFCDPEDEWEPDITDAPVSSLSRRRSRSLMKNRRISGCLHDIQVHPIKNLHSSHSSGLMDKSSTIYSNSAESFLPGICKELIGSSLDFFGQSYDEERTIADSLINSFLKIYNGLFAISKAHEEQDEESQDNLFSSDRAIQSLTIQTACAFEQLVVLMKHWLSDLLPCTNIARLEDELRQEVKKLGGYLQLFLQGCCLDISSMIKEAQKNAIQIVQQAVKYVGQLAVLKGSKLHFLENGNNKAASVQEEFMDAVCDGVGLGMKILLDSGLEKAKELQHELFRQCTKNEVTKEMKTNAMGLIRSLENIFAESKIKSFRRQVQEENFEYQDFKRMVNRAPEFLKLKHCLEKAIEIIISALKGCHSDINLLQTCVESIRNLASDFYSDFSVPSTSVGSYESRVTHIVHQELESLAKSLLFCFESEESPDLLKPWETYNQNTKEEHQQSKSSGIDGSKNKGVPKRVYELHGSSPAVSSEECTPSRIQWV

SEQ ID NO: 50825 - protein, 1690 aa, Homo sapiens
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDMTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 50826 - protein, 1799 aa, Homo sapiens
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMVSGPARNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDTNTVPGGPKLTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGSSAISGCNSYPLLNTCMSERMAALTPSPTFSSPDSDATEPAEEQSVGEEEEEEEEEEDEEEEDLEDDVFPEHALCDGRDPFYDRPPLFSLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRVSLGNDTRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 50827 - protein, 38 aa, Homo sapiens
MAGASVKVAVRVRPFNSREMSRDSKCIIQMSGSTTTIV

SEQ ID NO: 50828 - protein, 1791 aa, Homo sapiens
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDTNTVPGGPKLTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGSSAISGCNSYPLLNTCMSERMAALTPSPTFSSPDSDATEPAEEQSVGEEEEEEEEEEDEEEEDLEDDVFPEHALCDGRDPFYDRPPLFSLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 50829 - protein, 1770 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDTSMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRSKLSRRCPSQSKY

SEQ ID NO: 50830 - protein, 1823 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVDTSKKKSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRPGHLASEIIREDKSVSFSCQ

SEQ ID NO: 50831 - protein, 1823 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVDNCTSKSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRPGHLASEIIREDKSVSFSCQ

SEQ ID NO: 50832 - protein, 1153 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDTSMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDADSDSGDDSDKRSCEESWKLITSLREKLPPSKLQTIVKKCGLPSSGKKREPIKMYQIPQRRRLSKDSKWVTISDLKIQAVKEICYEVALNDFRHSRQEIEALAIVKMKELCAMYGKKDPNERDSWRAVARDVWDTVGVGDEKIEDVMATGKGSTDVDDLKVHIDKLEDILQEVKKQNNMKDEEIKVLRNKMLKMEKVLPLIGSQEQKSPGSHKAKEPVGAGVSSTSENNVSKGDNGELAKEERVSQLMNGDPAFRRGRLRWMRQEQIRFKNLQQQEITKQLRRQNVPHRFIPPENRKPRFPFKSNPKHRNSWSPGTHIIITEDEVIELRIPKDDEARKGNKEESQEKGGKGAFKDPQFPWGSQGMRSQDHIQVSKQHINNQQQPPQLRWRSNSLNNGQPKSTRCQASASAESLNSHSGHPTADVQTFQAKRHIHQHRQSYCNYNTGGQLEGNAATSYQKQTDKPSHCSQFVTPPRMRRQFSAPNLKAGRETTV

SEQ ID NO: 50833 - protein, 1816 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVDNCTSKSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDIDPLIDDYSGSGSKYLKDFQNNKHRYLLASENQRPGHFSTASMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRSKLSRRCPSQSKY

SEQ ID NO: 50834 - protein, 1153 aa, Homo sapiens; identical to SEQ ID NO: 50832

SEQ ID NO: 50835 - protein, 890 aa, Homo sapiens
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKLSLLNGGLQEEELSTSLKRSVYIESRIGTSTSFDSGIAGLSSISQCTSSSQLDETSHRWAQPDTAPLPVPANIRFSIWISFFEIYNELLYDLLEPPSQQRKRQTLRLCEDQNGNPYVKDLNWIHVQDAEEAWKLLKVGRKNQSFASTHLNQNSSRSHSIFSIRILHLQGEGDIVPKISELSLCDLAGSERCKDQKSGERLKEAGNINTSLHTLGRCIAALRQNQQNRSKQNLVPFRDSKLTRVFQGFFTGRGRSCMIVNVNPCASTYDETLHVAKFSAIASQLVHAPPMQLGFPSLHSFIKEHSLQVSPSLEKGAKADTGLDDDIENEADISMYGKEELLQVVEAMKTLLLKERQEKLQLEMHLRDEICNEMVEQMQQREQWCSEHLDTQKELLEEMYEEKLNILKESLTSFYQEEIQERDEKIEELEALLQEARQQSVAHQQSGSELALRRSQRLAASASTQQLQEVKAKLQQCKAELNSTTEELHKYQKMLEPPPSAKPFTIDVDKKLEEGQKNIRLLRTELQKLGESLQSAERACCHSTGAGKLRQALTTCDDILIKQDQTLAELQNNMVLVKLDLRKKAACIAEQYHTVLKLQGQVSAKKRLGTNQENQQPNQQPPGKKPFLRNLLPRTPTCQSSTDCSPYARILRSRRSPLLKSGPFGKKY

SEQ ID NO: 50836 - protein, 225 aa, Homo sapiens
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKL

SEQ ID NO: 50837 - protein, 872 aa, Homo sapiens
MSQGILSPPAGLLSDDDVVVSPMFESTAADLGSVVRKNLLSDCSVVSTSLEDKQQVPSEDSMEKEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKLSLLNGGLQEEELSTSLKRSVYIESRIGTSTSFDSGIAGLSSISQCTSSSQLDETSHRWAQPDTAPLPVPANIRFSIWISFFEIYNELLYDLLEPPSQQRKRQTLRLCEDQNGNPYVKDLNWIHVQDAEEAWKLLKVGRKNQSFASTHLNQNSSRSHSIFSIRILHLQGEGDIVPKISELSLCDLAGSERCKDQKSGERLKEAGNINTSLHTLGRCIAALRQNQQNRSKQNLVPFRDSKLTRVFQGFFTGRGRSCMIVNVNPCASTYDETLHVAKFSAIASQLVHAPPMQLGFPSLHSFIKEHSLQVSPSLEKGAKADTGLDDDIENEADISMYGKEELLQVVEAMKTLLLKERQEKLQLEMHLRDEICNEMVEQMQQREQWCSEHLDTQKELLEEMYEEKLNILKESLTSFYQEEIQERDEKIEELEALLQEARQQSVAHQQSGSELALRRSQRLAASASTQQLQEVKAKLQQCKAELNSTTEELHKYQKMLEPPPSAKPFTIDVDKKLEEGQKNIRLLRTELQKLGESLQSAERACCHSTGAGKLRQALTTCDDILIKQDQTLAELQNNMVLVKLDLRKKAACIAEQYHTVLKLQGQVSAKKRLGTNQENQQPNQQPPGKKPFLRNLLPRTPTCQSSTDCSPYARILRSRRSPLLKSGPFGKKY

SEQ ID NO: 50838 - protein, 159 aa, Homo sapiens
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTY

SEQ ID NO: 50839 - protein, 1627 aa, Homo sapiens
MLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKRLQKLEESNREERSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDFKHFFVENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKQSDESDSSLSEVHRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 50840 - protein, 1674 aa, Homo sapiens
MLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKRLQKLEESNREERSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKSDESDSSLSEVHRSSRRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 50841 - protein, 1661 aa, Homo sapiens
MLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKSDESDSSLSEVHRSSRRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 50842 - protein, 1675 aa, Homo sapiens
MLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKRLQKLEESNREERSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDFKHFFVENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKSDESDSSLSEVHRNSNLRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 50843 - protein, 1621 aa, Homo sapiens
MLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 50844 - protein, 1637 aa, Homo sapiens
MLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 50845 - protein, 661 aa, Homo sapiens
MNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKQGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 50846 - protein, 1624 aa, Homo sapiens
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDCRVKLWNYVPGLTPCLPRRVLAIKGRATTLP

SEQ ID NO: 50847 - protein, 1610 aa, Homo sapiens
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDLTVKFWSVRRLPHSGPP

SEQ ID NO: 50848 - protein, 1637 aa, Homo sapiens
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDCRVKLWNYVPGLTPCLPRRVLAIKGRATTLP

SEQ ID NO: 50849 - protein, 1623 aa, Homo sapiens
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDLTVKFWSVRRLPHSGPP

SEQ ID NO: 50850 - protein, 1668 aa, Homo sapiens
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDCRVKLWNYVPGLTPCLPRRVLAIKGRATTCPDPPQLSLSPLSFFPSFLFPLFPHFDLSCFLT

SEQ ID NO: 50851 - protein, 665 aa, Homo sapiens
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 50852 - protein, 72 aa, Homo sapiens
MLAQKAEEKENHCPTMLRPLSHRTVTGAKPLKKAVVMPLQLIQEQAASPNAEIHILKNKGRKRKGANITTGY

SEQ ID NO: 50853 - protein, 597 aa, Homo sapiens
MDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 50854 - protein, 597 aa, Homo sapiens; identical to SEQ ID NO: 50853

SEQ ID NO: 50855 - protein, 960 aa, Homo sapiens
MKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLSSNYIAQISNGQQLMSQPQLHRRSNSCSSISVASCISEWEQKIPTYNTPLKVTSIARRRQQEPGQSKTCIVSDRRRGMYWTEGREVVPTFRNEIEIEEDHCGRLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 50856 - protein, 673 aa, Homo sapiens
MITVQEFCKAEEVDEDSVYGVFVSYIEIYNNYIYDLLEEVPFDPIKPKWNSCSTPMRNTDFVPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 50857 - protein, 673 aa, Homo sapiens; identical to SEQ ID NO: 50856

SEQ ID NO: 50858 - protein, 856 aa, Homo sapiens
MKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 50859 - protein, 839 aa, Homo sapiens
MTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLSSNYIAQISNGQQLMSQPQLHRRSNSCSSISVASCISEWEQKIPTYNTPLKVTSIARRRQQEPGQSKTCIVSDRRRGMYWTEGREVVPTFRNEIEIEEDHCGRLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 50860 - protein, 1234 aa, Homo sapiens
MASWLYECLCEAELAQYYSHFTALGLQKIDELAKITMKDYSKLGVHDMNDRKRLFQLIKIIKIMQEEDKAVSIPERHLQTSSLRIKSQELRSGPRRQLNFDSPADNKDRNASNDGFEMCSLSDFSANEQKSTYLKVLEHMLPDDSQYHTKTGILNATAGDSYVQTEISTSLFSPNYLSAILGDCDIPIIQRISHVSGYNYGIPHSCIRQNTSEKQNPWTEMEKIRVCVRKRPLGMREVRRGEINIITVEDKETLLVHEKKEAVDLTQYILQVILKGSKERSTGATGVNADSSRSHAVIQIQIKDSAKRTFGRISFIDLAGSERAADARDSDRQTKMEGAEINQSLLALKECIRALDQEHTHTPFRQSKLTQVLKDSFIGNAKTCMIANISPSHVATEHTLNTLRYADRVKELKKGIKCCTSVTSRNRTSGNSSPKRIQSSPGALSEDKCSPKKVKLGFQQSLTVAAPGSTRGKVHPLTSHPPNIPFTSAPKVSGKRGGSRGSPSQEWVIHASPVKGTVRSGHVAKKKPEESAPLCSEKNRMGNKTVLGWESRASGPGEGLVRGKLSTKCKKVQTVQPVQKQLVSRVELSFGNAHHRAEYSQDSQRGTPARPASEAWTNIPPHQKEREEHLRFYHQQFQQPPLLQQKLKYQPLKRSLRQYRPPEGQLTNETPPLFHSYSENHDGAQVEELDDSDFSEDSFSHISSQRATKQRNTLENSEDSFFLHQTWGQGPEKQVAERQQSLFSSPRTGDKKDLTKSWVDSRDPINHRRAALDHSCSPSKGPVDWSRENSTSSGPSPRDSLAEKPYCSQVDFIYRQERGGGSSFDLRKDASQSEVSGENEGNLPSPEEDGFTISLSHVAVPGSPDQRDTVTTPLREVSADGPIQVTSTVKNGHAVPGEDPRGQLGTHAEYASGLMSPLTMSLLENPDNEGSPPSEQLVQDGATHSLVAESTGGPVVSHTVPSGDQEAALPVSSATRHLWLSSSPPDNKPGGDLPALSPSPIRQHPADKLPSREADLGEACQSRETVLFSHEHMGSEQYDADAEETGLDGSWGFPGKPFTTIHMGVPHSGPTLTPRTGSSDVADQLWAQERKHPTRLGWQEFGLSTDPIKLPCNSENVTWLKPRPISRCLARPSSPLVPSCSPKTAGTLRQPTLEQAQQVVIRAHQEQLDEMAELGFKEETLMSQLASNDFEDFVTQLDEIMVLKSKCIQSLRSQLQLYLTCHGPTAAPEGTVPS

SEQ ID NO: 50861 - protein, 1368 aa, Homo sapiens
MASWLYECLCEAELAQYYSHFTALGLQKIDELAKITMKDYSKLGVHDMNDRKRLFQLIKIIKIMQEEDKAVSIPERHLQTSSLRIKSQELRSGPRRQLNFDSPADNKDRNASNDGFEMCSLSDFSANEQKSTYLKVLEHMLPDDSQYHTKTGILNATAGDSYVQTEISTSLFSPNYLSAILGDCDIPIIQRISHVSGYNYGIPHSCIRQNTSEKQNPWTEMEKIRVCVRKRPLGMREVRRGEINIITVEDKETLLVHEKKEAVDLTQYILQHVFYFDEVFGEACTNQDVYMKTTHPLIQHIFNGGNATCFAYGQTGAGKTYTMIGTHENPGLYALAAKDIFRQLEVSQPRKHLFVWISFYEIYCGQLYDLLNRRKRLFAREDSKHMVQIVGLQELQVDSVELLLEVILKGSKERSTGATGVNADSSRSHAVIQIQIKDSAKRTFGRISFIDLAGSERAADARDSDRQTKMEGAEINQSLLALKECIRALDQEHTHTPFRQSKLTQVLKDSFIGNAKTCMIANISPSHVATEHTLNTLRYADRVKELKKGIKCCTSVTSRNRTSGNSSPKRIQSSPGALSEDKCSPKKVKLGFQQSLTVAAPGSTRGKVHPLTSHPPNIPFTSAPKVSGKRGGSRGSPSQEWVIHASPVKGTVRSGHVAKKKPEESAPLCSEKNRMGNKTVLGWESRASGPGEGLVRGKLSTKCKKVQTVQPVQKQLVSRVELSFGNAHHRAEYSQDSQRGTPARPASEAWTNIPPHQKEREEHLRFYHQQFQQPPLLQQKLKYQPLKRSLRQYRPPEGQLTNETPPLFHSYSENHDGAQVEELDDSDFSEDSFSHISSQRATKQRNTLENSEDSFFLHQTWGQGPEKQVAERQQSLFSSPRTGDKKDLTKSWVDSRDPINHRRAALDHSCSPSKGPVDWSRENSTSSGPSPRDSLAEKPYCSQVDFIYRQERGGGSSFDLRKDASQSEVSGENEGNLPSPEEDGFTISLSHVAVPGSPDQRDTVTTPLREVSADGPIQVTSTVKNGHAVPGEDPRGQLGTHAEYASGLMSPLTMSLLENPDNEGSPPSEQLVQDGATHSLVAESTGGPVVSHTVPSGDQEAALPVSSATRHLWLSSSPPDNKPGGDLPALSPSPIRQHPADKLPSREADLGEACQSRETVLFSHEHMGSEQYDADAEETGLDGSWGFPGKPFTTIHMGVPHSGPTLTPRTGSSDVADQLWAQERKHPTRLGWQEFGLSTDPIKLPCNSENVTWLKPRPISRCLARPSSPLVPSCSPKTAGTLRQPTLEQAQQVVIRAHQEQLDEMAELGFKEETLMSQLASNDFEDFVTQLDEIMVLKSKCIQSLRSQLQLYLTCHGPTAAPEGTVPS

SEQ ID NO: 50862 - protein, 1368 aa, Homo sapiens; identical to SEQ ID NO: 50861

SEQ ID NO: 50863 - protein, 1158 aa, Homo sapiens
MASWLYECLCEAELAQYYSHFTALGLQKIDELAKITMKDYSKLGVHDMNDRKRLFQLIKIIKIMQEEDKAVSIPERHLQTSSLRIKSQELRSGPRRQLNFDSPADNKDRNASNDGFEMCSLSDFSANEQKSTYLKVLEHMLPDDSQYHTKTGILNATAGDSYVQTEISTSLFSPNYLSAILGDCDIPIIQRISHVSGYNYGIPHSCIRQNTSEKQNPWTEMEKIRVCVRKRPLGMREVRRGEINIITVEDKETLLVHEKKEAVDLTQYILQHVFYFDEVFGEACTNQDVYMKTTHPLIQHIFNGGNATCFAYGQTGAGKTYTMIGTHENPGLYALAAKDIFRQLEVSQPRKHLFVWISFYEIYCGQLYDLLNRRKRLFAREDSKHMVQIVGLQELQVDSVELLLEVILKGSKERSTGATGVNADSSRSHAVIQIQIKDSAKRTFGRISFIDLAGSERAADARDSDRQTKMEGAEINQSLLALKECIRALDQEHTHTPFRQSKLTQVLKDSFIGNAKTCMIANISPSHVATEHTLNTLRYADRVKELKKGIKCCTSVTSRNRTSGNSSPKRIQSSPGALSEDKCSPKKVKLGFQQSLTVAAPGSTRGKVHPLTSHPPNIPFTSAPKVSGKRGGSRGSPSQEWVIHASPVKGTVRSGHVAKKKPEESAPLCSEKNRMGNKTVLGWESRASGPGEGLVRGKLSTKCKKVQTVQPVQKQLVSRVELSFGNAHHRAEYSQDSQRGTPARPASEAWTNIPPHQKEREEHLRFYHQQFQQPPLLQQKLKYQPLKRSLRQYRPPEGQLTNETPPLFHSYSENHDGAQVEELDDSDFSEDSFSHISSQRATKQRNTLENSEDSFFLHQTWGQGPEKQVAERQQSLFSSPRTGDKKDLTKSWVDSRDPINHRRAALDHSCSPSKGPVDWSRENSTSSGPSPRDSLAEKPYCSQVDFIYRQERGGGSSFDLRKDASQSEVSGENEGNLPSPEEDGFTISLSHVAVPGSPDQRDTVTTPLREVSADGPIQVTSTVKNGHAVPGEDPRGQLGTHAEYASGLMSPLTMSLLENPDNEGSPPSEQLVQDGATHSLVAESTGGPVVSHTVPSGDQEAALPVSSATRHLWLSSSPPDNKPGGDLPALGPGEKTSYKAWLAGVWFVHRPHQVALQQ

SEQ ID NO: 50864 - protein, 332 aa, Homo sapiens
MTWTSGQLQREKQARPGSGAVLAFPDDKDLRVYGPAESQSAVFGDVCPLLTSLLDGYNVCVMAYGQTGSGKSYTMLGRHSDDGPVLPLDPQSDLGIIPRVAEELFRLILENTSRSPKVEVSIVEVYNNDIFDLLAKDSIAAVSGVKREVVTAKDGRTEVALLASEAVGSASKLMELVHGGLQLRAKHPTLVHADSSRSHLIITVTLTTASCSDSTADQACSATLPREQTEAGRAGRSRRASQGALAPQLVPGNPAGHAEQVQARLQLVDSAGSECVGGDAKLLVILCISPSQRHLAQTLQGLGFGIRARQVQRGPARKKPPSSQTEGKRRPD

SEQ ID NO: 50865 - protein, 384 aa, Homo sapiens
MTWTSGQLQREKQARPGSGAVLAFPDDKDLRVYGPAESQSAVFGDVCPLLTSLLDGYNVCVMAYGQTGSGKSYTMLGRHSDDGPVLPLDPQSDLGIIPRVAEELFRLILENTSRSPKVEVSIVEVYNNDIFDLLAKDSIAAVSGVKREVVTAKDGRTEVALLASEAVGSASKLMELVHGGLQLRAKHPTLVHADSSRSHLIITVTLTTASCSDSTADQACSATLPREQTEAGRAGRSRRASQGALAPQLVPGNPAGHAEQVQARLQLVDSAGSECVGVSGVTGLALREMACISRSLAALAGVLGALLEHRGHAPYRNSRLTHLLQDCLGGDAKLLVILCISPSQRHLAQTLQGLGFGIRARQVQRGPARKKPPSSQTEGKRRPD

SEQ ID NO: 50866 - protein, 384 aa, Homo sapiens; identical to SEQ ID NO: 50865

SEQ ID NO: 50867 - protein, 1882 aa, Homo sapiens
MVGRGVPLCAAQPAVAEGGPAREPPPLLEVSPRKRLPAGPDQDPCGSRPAPEGAGAGPEQGHSAGGGGWCRHCHTKLVELKRQAWKLVSGPGTTLRDPCLSALLLDKLPAPGALPACRPEAERRCDVCATHLQQLTREAMHLLQAPASHEDLDAPHGGPSLAPPSTTTSSRDTPGPAGPAGRQPGRAGPDRTKGLAWSPGPSVQVSVAPAGLGGALSTVTIQAQQCLEGMWSVSRVNSFLPPACLAEAAVAAVAVADTVRECPPVAGPDGLSKAWGRGGVCTSALVTPTPGSVGGSTGPSAAASFFIRAMQKLSLASKRKKPHPPPPPATRGTSTYPTDFSGVLQLWPPPAPPCLLRAASKTKDNPGSIGKVKVMLRIWPAQGAQRSAEAMSFLKVDPRKKQVILYDPAAGPPGSAGPRRAATAAVPKMFAFDAVFPQDSEQAEVCSGTVADVLQSVVSGADGCIFSFGHMSLGKSYTMIGKDSSPQSLGIVPCAISWLFRLIEERRERTGTRFSVRVSAVEVCGRDQSLRDLLAEVAPGSLQDTQSPGVYLREDPVCGAQLQNQSELRAPTAEKAAFYLDAALAARSTSRAGCGEDARRSSHMLFTLHVYQYRMEKCGRGGMSGGRSRLHLIDLGSCEAAAGRAGEAAGGPLCLSLSALGSVILALVNGAKHVPYRDHRLTMLLRESLATAGCRTTMIAHVSDAPAQHAETLSTVQLAARIHRLRRKKAKYASSSSGGESSCEEGRARRPPHLRPFHPRTVALDPDRTPPCLPGDPDYSSSSEQSCDTVIYVGPGGAALSDRELTDNEGPPDFVPIIPALSRHRPSKGPRDADHFRCSTFAELQERLECMDGNEGPSGGPGGTDGAQASPARGGRKPSPPEAASPRKAVGTPMAASTPRGSSGPDTHQGTPEPCKAIVWGDQREDSSAWPELLVPEKAAVSGGRRPLPSPAPPPPQLLEACRAPEEPGGGGTDGVARTPPVGMSGQVAGSPMLPGATCPRLAAGSRCPERGLLTTTVTLQRPVELNGEDELVFTVVEELSLGALAGAGRPTSLASFDSDCSLRALASGSRPVSIISSINDEFDAYTSQAPEGGPLEGAAWAGSSHGSSISSWLSEVSVCTADSRDPTPQPRFSPDSLAGLDPGGPPALDGSLGDGSSGFLGPDRPDSPGPTWGPCPGEVAAVAPSRPGREPQAGPSRWASAAQTIHSSLPRKPRTASATTRVGCARLGQSPPGRGGLFEDPWLLRVGECDTQAASAGRAPSPTLGSPRLPEAQVMLACAQRVVDGCEVAARAARRPEAVARIPPLRRGATTLGVTTPAVSWGDAPTEVVACSGSLKASPTSKKGLAPKAGFLPRPSGAAPPAPPTRKSSLEQRSSPASAPPHAVNPARVGAAAVLRGEEEPRPSSRADHSVPRATSSLKARASKVEAAHRLAGHASLERYEGLAHSSSKGREAPGRPPRAVPKLGVPPSSPTHGPAPACRSGAAKAVGAPKPPVGGGKGRGLVAGGSRALGPSVKLSTASVTGRSPGGPVAGPRAAPRAGPSVGAKAGRGTVMGTKQALRAAHSRVHELSASGAPGRGGSSWGSADSDSGHDSGVNVGEERPPTGPALPSPYSKVTAPRRPQRYSSGHGSDNSSVLSGELPPAMGRTALFHHSGGSSGYESLRRDSEATGSASSAPDSMSESGAASPGARTRSLKSPKKRATGLQRRRLIPAPLPDTTALGRKPSLPGQWVDLPPPLAGSLKEPFEIKVYEIDDVERLQRPRPTPREAPTQGLACVSTRLRLAERRQQRLREVQAKHKHLCEELAETQGRLMLEPGRWLEQFEVDPELEPESAEYLAALERATAALEQCVNLCKAHVMMVTCFDISVAASAAIPGPQEVDV

SEQ ID NO: 50868 - protein, 1727 aa, Homo sapiens
MMMDWKAVAAQKLNLSSKKKKHRPSTSSAAEPPLFATSFSGILQTSPPPAPPCLLRAVNKVKDTPGLGKVKVMLRICSTLARDTSESSSFLKVDPRKKQITLYDPLTCGGQNAFQKRGNQVPPKMFAFDAVFPQDASQAEVCAGTVAEVIQSVVNGADGCVFCFGHAKLGKSYTMIGKDDSMQNLGIIPCAISWLFKLINERKEKTGARFSVRVSAVEVWGKEENLRDLLSEVATGSLQDGQSPGVYLCEDPICGTQLQNQSELRAPTAEKAAFFLDAAIASRRSHQQDCDEDDHRNSHVFFTLHIYQYRMEKSGKGGMSGGRSRLHLIDLGSCVKALSKNREGGSGLCLSLSALGNVILALVNGSKHIPYKESKLAMLLRESLGNMNCRTTMIAHISAAVGSYAETLSTIQIASRVLRMKKKKTKYTSSSSGGESSCEEGRMRRPTQLRPFHTRATVDPDFPIAHLSSDPDYSSSSEQSCDTVIYIGPNGTALSDKELTDNEGPPDFVPIVPALQKTRGDSRPAEAGEAAAGKSERDCLKCNTFAELQERLDCIDGSEEPSSFPFEELPAQFGPEQASRGPRLSQAAGASPLSESDKEDNGSEGQLTNREGPELPASKMQRSHSPVPAAAPAHSPSPASPRSVPGSSSQHSASPLVQSPSLQSSRESLNSCGFVEGKPRPMGSPRLGIASLSKTSEYKPPSSPSQRCKVYTQKGVLPSPAPLPPSSKDSGVASRESLLQPEVRTPPVGMSPQVLKKSMSAGSEGFPETPVDDEQQAATPSESKKEILSTTMVTVQQPLELNGEDELVFTLVEELTISGVLDSGRPTSIISFNSDCSARALASGSRPVSIISSISEDLECYSSTAPVSEVSITQFLPLPKMSLDEKAQDAGSRRSSISSWLSEMSAGSEGEQSCHSFIAQTCFGHGEAMAEPVASEFVSSLQNTAVVCREKPKASPDNLLILSEMGDDSFNKAAPIKGCKISTVSKAMVTISNTANLSSCEGYIPMKTNITVYPCIAMSPRNIQEPEAPTATPKAGPTLAQSRESKENSAKKEMKFEDPWLKREEEVKKETAHPNEEGMMRCETATGPSNAETRAEQEQDGKPSPGDRLSSSSGEVSASPVTDNFRRVVDGCEMALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 50869 - protein, 2108 aa, Homo sapiens
MNSVAGNKERLAVSTRGKKYGVNEVCSPTKPAAPFSPESWYRKAYEESRAGSRPTPEGAGSALGSSGTPSPGSGTSSPSSFTGSPGPASPGIGTSSPGSLGGSPGFGTGSPGSGSGGGSSPGSDRGVWCENCNARLVELKRQALRLLLPGPFPGKDPAFSAVIHDKLQVPNTIRKAWNDRDNRCDICATHLNQLKQEAIQMVLTLEQAAGSEHYDASPCSPPPLSNIPTLVGSRHVGGLQQPRDWAFVPAPCATSNYTGFANKHGSKPSSLGVSNGAEKKSGSPTHQAKVSLQMATSPSNGNILNSVAIQAHQYLDGTWSLSRTNGVTLYPYQISQLMTESSREGLTEAVLNRYNADKPSACSVPASQGSCVASETSTGTSVAASFFARAAQKLNLSSKKKKHRPSTSSAAEPPLFATSFSGILQTSPPPAPPCLLRAVNKVKDTPGLGKVKVMLRICSTLARDTSESSSFLKVDPRKKQITLYDPLTCGGQNAFQKRGNQVPPKMFAFDAVFPQDASQAEVCAGTVAEVIQSVVNGADGCVFCFGHAKLGKSYTMIGKDDSMQNLGIIPCAISWLFKLINERKEKTGARFSVRVSAVEVWGKEENLRDLLSEVATGSLQDGQSPGVYLCEDPICGTQLQNQSELRAPTAEKAAFFLDAAIASRRSHQQDCDEDDHRNSHVFFTLHIYQYRMEKSGKGGMSGGRSRLHLIDLGSCVKALSKNREGGSGLCLSLSALGNVILALVNGSKHIPYKESKLAMLLRESLGNMNCRTTMIAHISAAVGSYAETLSTIQIASRVLRMKKKKTKYTSSSSGGESSCEEGRMRRPTQLRPFHTRATVDPDFPIAHLSSDPDYSSSSEQSCDTVIYIGPNGTALSDKELTDNEGPPDFVPIVPALQKTRGDSRPAEAGEAAAGKSERDCLKCNTFAELQERLDCIDGSEEPSSFPFEELPAQFGPEQASRGPRLSQAAGASPLSESDKEDNGSEGQLTNREGPELPASKMQRSHSPVPAAAPAHSPSPASPRSVPGSSSQHSASPLVQSPSLQSSRESLNSCGFVEGKPRPMGSPRLGIASLSKTSEYKPPSSPSQRCKVYTQKGVLPSPAPLPPSSKDSGVASRESLLQPEVRTPPVGMSPQVLKKSMSAGSEGFPETPVDDEQQAATPSESKKEILSTTMVTVQQPLELNGEDELVFTLVEELTISGVLDSGRPTSIISFNSDCSARALASGSRPVSIISSISEDLECYSSTAPVSEVSITQFLPLPKMSLDEKAQDAGSRRSSISSWLSEMSAGSEGEQSCHSFIAQTCFGHGEAMAEPVASEFVSSLQNTAVVCREKPKASPDNLLILSEMGDDSFNKAAPIKGCKISTVSKAMVTISNTANLSSCEGYIPMKTNITVYPCIAMSPRNIQEPEAPTATPKAGPTLAQSRESKENSAKKEMKFEDPWLKREEEVKKETAHPNEEGMMRCETATGPSNAETRAEQEQDGKPSPGDRLSSSSGEVSASPVTDNFRRVVDGCEMALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 50870 - protein, 1724 aa, Homo sapiens
DWKTKAAQKLNLSSKKKKHRPSTSSAAEPPLFATSFSGILQTSPPPAPPCLLRAVNKVKDTPGLGKVKVMLRICSTLARDTSESSSFLKVDPRKKQITLYDPLTCGGQNAFQKRGNQVPPKMFAFDAVFPQDASQAEVCAGTVAEVIQSVVNGADGCVFCFGHAKLGKSYTMIGKDDSMQNLGIIPCAISWLFKLINERKEKTGARFSVRVSAVEVWGKEENLRDLLSEVATGSLQDGQSPGVYLCEDPICGTQLQNQSELRAPTAEKAAFFLDAAIASRRSHQQDCDEDDHRNSHVFFTLHIYQYRMEKSGKGGMSGGRSRLHLIDLGSCVKALSKNREGGSGLCLSLSALGNVILALVNGSKHIPYKESKLAMLLRESLGNMNCRTTMIAHISAAVGSYAETLSTIQIASRVLRMKKKKTKYTSSSSGGESSCEEGRMRRPTQLRPFHTRATVDPDFPIAHLSSDPDYSSSSEQSCDTVIYIGPNGTALSDKELTDNEGPPDFVPIVPALQKTRGDSRPAEAGEAAAGKSERDCLKCNTFAELQERLDCIDGSEEPSSFPFEELPAQFGPEQASRGPRLSQAAGASPLSESDKEDNGSEGQLTNREGPELPASKMQRSHSPVPAAAPAHSPSPASPRSVPGSSSQHSASPLVQSPSLQSSRESLNSCGFVEGKPRPMGSPRLGIASLSKTSEYKPPSSPSQRCKVYTQKGVLPSPAPLPPSSKDSGVASRESLLQPEVRTPPVGMSPQVLKKSMSAGSEGFPETPVDDEQQAATPSESKKEILSTTMVTVQQPLELNGEDELVFTLVEELTISGVLDSGRPTSIISFNSDCSARALASGSRPVSIISSISEDLECYSSTAPVSEVSITQFLPLPKMSLDEKAQDAGSRRSSISSWLSEMSAGSEGEQSCHSFIAQTCFGHGEAMAEPVASEFVSSLQNTAVVCREKPKASPDNLLILSEMGDDSFNKAAPIKGCKISTVSKAMVTISNTANLSSCEGYIPMKTNITVYPCIAMSPRNIQEPEAPTATPKAGPTLAQSRESKENSAKKEMKFEDPWLKREEEVKKETAHPNEEGMMRCETATGPSNAETRAEQEQDGKPSPGDRLSSSSGEVSASPVTDNFRRVVDGCEMALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 50871 - protein, 671 aa, Homo sapiens
MIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 50872 - protein, 684 aa, Homo sapiens
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPLRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 50873 - protein, 612 aa, Homo sapiens
MSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 50874 - protein, 725 aa, Homo sapiens
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 50875 - protein, 107 aa, Homo sapiens
  MOD_RES (1)..(1): Any amino acid
XKECIRALGQNKAHTPFRESKLTQVLRDSFIGENSRTCMIATISPGISSCEYTLNTLRYADRQGCHSIPLEPQASKPGRCHIPLLSKEEEELSSQMSSFNEAMTQIR

SEQ ID NO: 50876 - protein, 336 aa, Homo sapiens
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPLRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMA

SEQ ID NO: 50877 - protein, 287 aa, Homo sapiens
MVRSGVPRSRGLVSGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKL

SEQ ID NO: 50878 - protein, 747 aa, Homo sapiens
MSKLKSSESVRVVVRCRPMNGKEKAASYDKVVDVDVKLGQVSVKNPKGTAHEMPKTFTFDAVYDWNAKQFELYDETFRPLVDSVLQGFNGTIFAYGQTGTGKTYTMEGIRGDPEKRGVIPNSFDHIFTHISRSQNQQYLVRASYLEIYQEEIRDLLSKDQTKRLELKERPDTGVYVKDLSSFVTKSVKEIEHVMNVGNQNRSVGATNMNEHSSRSHAIFVITIECSEVGLDGENHIRVGKLNLVDLAGSERQAKTGAQGERLKEATKINLSLSALGNVISALVDGKSTHIPYRDSKLTRLLQDSLGGNAKTVMVANVGPASYNVEETLTTLRYANRAKNIKNKPRVNEDPKDALLREFQEEIARLKAQLEKRSIGRRKRREKRREGGGSGGGGEEEEEEGEEGEEEGDDKDDYWREQQEKLEIEKRAIVEDHSLVAEEKMRLLKEKEKKMEDLRREKDAAEMLGAKIKAMESKLLVGGKNIVDHTNEQQKILEQKRQEIAEQKRREREIQQQMESRDEETLELKETYSSLQQEVDIKTKKLKKLFSKLQAVKAEIHDLQEEHIKERQELEQTQNELTRELKLKHLIIENFIPLEEKSKIMNRAFFDEEEDHWKLHPITRLENQQMMKRPVSAVGYKRPLSQHARMSMMIRPEARYRAENIVLLELDMPSRTTRDYEGPAIAPKVQAALDAALQDEDEIQVDASSFESTANKKSKARPKSGRKSGSSSSSSGTPASQLYPQSRGLVPK

SEQ ID NO: 50879 - protein, 373 aa, Homo sapiens
MVANVGPASYNVEETLTTLRYANRAKNIKNKPRVNEDPKDALLREFQEEIARLKAQLEKRSIEEKMRLLKEKEKKMEDLRREKDAAEMLGAKIKAMESKLLVGGKNIVDHTNEQQKILEQKRQEIAEQKRREREIQQQMESRDEETLELKETYSSLQQEVDIKTKKLKKLFSKLQAVKAEIHDLQEEHIKERQELEQTQNELTRELKLKHLIIENFIPLEEKSKIMNRAFFDEEEDHWKLHPITRLENQQMMKRPVSAVGYKRPLSQHARMSMMIRPEARYRAENIVLLELDMPSRTTRDYEGPAIAPKVQAALDAALQDEDEIQVDASSFESTANKKSKARPKSGRKSGSSSSSSGTPASQLYPQSRGLVPK

SEQ ID NO: 50880 - protein, 793 aa, Homo sapiens
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPQVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRAENIMFLELDVSPPAVFEMEFSHDQEQDPRALHMERLMRLDSFLERPSTSKVRKSRSWCQSPQRPPPSTTHASLASASLRPATVADHE

SEQ ID NO: 50881 - protein, 793 aa, Homo sapiens; identical to SEQ ID NO: 50880

SEQ ID NO: 50882 - protein, 599 aa, Homo sapiens
MNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPQVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRAENIMFLELDVSPPAVFEMEFSHDQEQDPRALHMERLMRLDSFLERPSTSKVRKSRSWCQSPQRPPPSTTHASLASASLRPATVADHE

SEQ ID NO: 50883 - protein, 1127 aa, Homo sapiens
MKEEVKGIPVRVALRCRPLVPKEISEGCQMCLSFVPGEPQVVVGTDKSFTYDFVFDPSTEQEEVFNTAVAPLIKGVFKGYNATVLAYGQTGSGKTYSMGGAYTAEQENEPTVGVIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISLEQRKKSDKNSSFRSKLHLVDLAGSERQKKTKAEGDRLKEGININRGLLCLGNVISALGDDKKGGFVPYRDSKLTRLLQDSLGGNSHTLMIACVSPADSNLEETLNTLRYADRARKIKNKPIVNIDPQTAELNHLKQQVQQLQVLLLQAHGGTLPGSITVEPSENLQSLMEKNQSLVEENEKLSRGLSEAAGQTAQMLERIILTEQANEKMNAKLEELRQHAACKLDLQKLVETLEDQELKENVEIICNLQQLITQLSDETVACMAAAIDTAVEQEAQVETSPETSRSSDAFTTQHALRQAQMSKELVELNKALALKEALARKMTQNDSQLQPIQYQYQDNIKELELEVINLQKEKEELVLELQTAKKDANQAKLSERRRKRLQELEGQIADLKKKLNEQSKLLKLKESTERTVSKLNQEIRMMKNQRVQLMRQMKEDAEKFRQWKQKKDKEVIQLKERDRKRQYELLKLERNFQKQSNVLRRKTEEAAAANKRLKDALQKQREVADKRKETQSRGMEGTAARVKNWLGNEIEVMVSTEEAKRHLNDLLEDRKILAQDVAQLKEKKESGENPPPKLRRRTFSLTEVRGQVSESEDSITKQIESLETEMEFRSAQIADLQQKLLDAESEDRPKQRWENIATILEAKCALKYLIGELVSSKIQVSKLESSLKQSKTSCADMQKMLFEERNHFAEIETELQAELVRMEQQHQEKVLYLLSQLQQSQMAEKQLEESVSEKEQQLLSTLKCQDEELEKMREVCEQNQQLLRENEIIKQKLTLLQVASRQKHLPKDTLLSPDSSFEYVPPKPKPSRVKEKFLEQSMDIEDLKYCSEHSVNEHEDGDGDDDEGDDEEWKPTKLVKVSRKNIQGVLLLTPVISALWEAEARGLLEARSSRPAWATWRDPVSTKPKN

SEQ ID NO: 50884 - protein, 1232 aa, Homo sapiens
MKEEVKGIPVRVALRCRPLVPKEISEGCQMCLSFVPGEPQVVVGTDKSFTYDFVFDPSTEQEEVFNTAVAPLIKGVFKGYNATVLAYGQTGSGKTYSMGGAYTAEQENEPTVGVIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISLEQRKKSDKNSSFRSKLHLVDLAGSERQKKTKAEGDRLKEGININRGLLCLGNVISALGDDKKGGFVPYRDSKLTRLLQDSLGGNSHTLMIACVSPADSNLEETLNTLRYADRARKIKNKPIVNIDPQTAELNHLKQQVQQLQVLLLQAHGGTLPGSITVEPSENLQSLMEKNQSLVEENEKLSRGLSEAAGQTAQMLERIILTEQANEKMNAKLEELRQHAACKLDLQKLVETLEDQELKENVEIICNLQQLITQLSDETVACMAAAIDTAVEQEAQVETSPETSRSSDAFTTQHALRQAQMSKELVELNKALALKEALARKMTQNDSQLQPIQYQYQDNIKELELEVINLQKEKEELVLELQTAKKDANQAKLSERRRKRLQELEGQIADLKKKLNEQSKLLKLKESTERTVSKLNQEIRMMKNQRVQLMRQMKEDAEKFRQWKQKKDKEVIQLKERDRKRQYELLKLERNFQKQSNVLRRKTEEAAAANKRLKDALQKQREVADKRKETQSRGMEGTAARVKNWLGNEIEVMVSTEEAKRHLNDLLEDRKILAQDVAQLKEKKESGENPPPKLRRRTFSLTEVRGQVSESEDSITKQIESLETEMEFRSAQIADLQQKLLDAESEDRPKQRWENIATILEAKCALKYLIGELVSSKIQVSKLESSLKQSKTSCADMQKMLFEERNHFAEIETELQAELVRMEQQHQEKVLYLLSQLQQSQMAEKQLEESVSEKEQQLLSTLKCQDEELEKMREVCEQNQQLLRENEIIKQKLTLLQVASRQKHLPKDTLLSPDSSFEYVPPKPKPSRVKEKFLEQSMDIEDLKYCSEHSVNEHEDGDGDDDEGDDEEWKPTKLVKVSRKNIQGCSCKGWCGNKQCGCRKQKSDCGVDCCCDPTKCRNRQQGKDSLGTVERTQDSEGSFKLEDPTEVTPGLSFFNPVCATPNSKILKEMCDVEQVLSKKTPPAPSPFDLPELKHVATEYQENKAPGKKKKRALASNTSFFSGCSPIEEEAH

SEQ ID NO: 50885 - protein, 534 aa, Homo sapiens
MCSDVKREAAAANKRLKDALQKQREVADKRKETQSRGMEGTAARVKNWLGNEIEVMVSTEEAKRHLNDLLEDRKILAQDVAQLKEKKESGENPPPKLRRRTFSLTEVRGQVSESEDSITKQIESLETEMEFRSAQIADLQQKLLDAESEDRPKQRWENIATILEAKCALKYLIGELVSSKIQVSKLESSLKQSKTSCADMQKMLFEERNHFAEIETELQAELVRMEQQHQEKVLYLLSQLQQSQMAEKQLEESVSEKEQQLLSTLKCQDEELEKMREVCEQNQQLLRENEIIKQKLTLLQVASRQKHLPKDTLLSPDSSFEYVPPKPKPSRVKEKFLEQSMDIEDLKYCSEHSVNEHEDGDGDDDEGDDEEWKPTKLVKVSRKNIQGCSCKGWCGNKQCGCRKQKSDCGVDCCCDPTKCRNRQQGKDSLGTVERTQDSEGSFKLEDPTEVTPGLSFFNPVCATPNSKILKEMCDVEQVLSKKTPPAPSPFDLPELKHVATEYQENKAPGKKKKRALASNTSFFSGCSPIEEEAH

SEQ ID NO: 50886 - protein, 1234 aa, Homo sapiens
MKEEVKGIPVRVALRCRPLVPKEISEGCQMCLSFVPGETQVVVGTDKSFTYDFVFDPCTEQEEVFNKAVAPLIKGIFKGYNATVLAYGQTGSGKTYSMGGAYTAEQENEPTVGIIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISIEQRKKSDKNCSFRSKLHLVDLAGSERQKKTKAEGDRLKEGININRGLLCLGNVISALGDDKKGSFVPYRDSKLTRLLQDSLGGNSHTLMIACVSPADSNLEETLSTLRYADRARKIKNKPIVNIDPHTAELNHLKQQVQQLQVLLLQAHGGTLPGSINAEPSENLQSLMEKNQSLVEENEKLSRCLSKAAGQTAQMLERIILTEQVNEKLNAKLEELRQHVACKLDLQKLVETLEDQELKENVEIICNLQQLITQLSDETVACTAAAIDTAVEEEAQVETSPETSRSSDAFTTQHALHQAQMSKEVVELNNALALKEALVRKMTQNDNQLQPIQFQYQDNIKNLELEVINLQKEKEELVRELQTAKKNVNQAKLSEHRHKLLQELEGQIADLKKKLNEQSKLLKLKESTERTVSKLNQEIWMMKNQRVQLMRQMKEDAEKFRQWKQKKDKEVIQLKERDRKRQYELLKLERNFQKQSSVLRRKTEEAAAANKRLKDALQKQREVTDKRKETQSHGKEGIAARVRNWLGNEIEVMVSTEEAKRHLNDLLEDRKILAQDVVQLKEKKESRENPPPKLRKCTFSLSEVHGQVLESEDCITKQIESLETEMELRSAQIADLQQKLLDAESEDRPKQCWENIATILEAKCALKYLIGELVSSKIHVTKLENSLRQSKASCADMQKMLFEEQNHFSEIETELQAELVRMEQQHQEKVLYLVSQLQESQMAEKQLEKSASEKEQQLVSTLQCQDEELEKMREVCEQNQQLLQENEIIKQKLILLQVASRQKHLPNDTLLSPDSSFEYIPPKPKPSRVKEKFLEQSMDIEDLKYCSEHSVNEHEDGDGDGDSDEGDDEEWKPTKLVKVSRKNIQGCSCKGWCGNKQCGCRKQKSDCGVDCSCDPTKCRNRQQGKDSLGTVEQTQDSEGSFKLEDPTEVTPGLSFFNPVCATPNSKILKEMCDMEQVLSKKTAPAPSPFDLPESKHGATEYQQNKPPGKKKKRALASNTSFFSGCSPIEEEAH

SEQ ID NO: 50887 - protein, 1032 aa, Homo sapiens
MAETNNECSIKVLCRFRPLNQAEILRGDKFIPIFQGDDSVVIGGKPYVFDRVFPPNTTQEQVYHACAMQIVKDVLAGYNGTIFAYGQTSSGKTHTMEGKLHDPQLMGIIPRIARDIFNHIYSMDENLEFHIKVSYFEIYLDKIRDLLDVTKTNLSVHEDKNRVPFVKGCTERFVSSPEEILDVIDEGKSNRHVAVTNMNEHSSRSHSIFLINIKQENMETEQKLSGKLYLVDLAGSEKVSKTGAEGAVLDEAKNINKSLSALGNVISALAEGTKSYVPYRDSKMTRILQDSLGGNCRTTMFICCSPSSYNDAETKSTLMFGQRAKTIKNTASVNLELTAEQWKKKYEKEKEKTKAQKETIAKLEAELSRWRNGENVPETERLAGEEAALGAELCEETPVNDNSSIVVRIAPEERQKYEEEIRRLYKQLDDKDDEINQQSQLIEKLKQQMLDQEELLVSTRGDNEKVQRELSHLQSENDAAKDEVKEVLQALEELAVNYDQKSQEVEEKSQQNQLLVDELSQKVATMLSLESELQRLQEVSGHQRKRIAEVLNGLMKDLSEFSVIVGNGEIKLPVEISGAIEEEFTVARLYISKIKSEVKSVVKRCRQLENLQVECHRKMEVTGRELSSCQLLISQHEAKIRSLTEYMQSVELKKRHLEESYDSLSDELAKLQAQETVHEVALKDKEPDTQDADEVKKALELQMESHREAHHRQLARLRDEINEKQKTIDELKDLNQKLQLELEKLQADYEKLKSEEHEKSTKLQELTFLYERHEQSKQDLKGLEETVARELQTLHNLRKLFVQDVTTRVKKSAEMEPEDSGGIHSQKQKISFLENNLEQLTKVHKQLVRDNADLRCELPKLEKRLRATAERVKALEGALKEAKEGAMKDKRRYQQEVDRIKEAVRYKSSGKRGHSAQIAKPVRPGHYPASSPTNPYGTRSPECISYTNSLFQNYQNLYLQATPSSTSDMYFANSCTSSGATSSGGPLASYQKANMDNGNATDINDNRSDLPCGYEAEDQAKLFPLHQETAAS

SEQ ID NO: 50888 - protein, 126 aa, Homo sapiens
KSSGKRGHSAQIAKPVRPGHYPASSPTNPYGTRSPECISYTNSLFQNYQNLYLQATPSSTSDMYFANSCTSSGATSSGGPLASYQKANMDNGNATDINDNRSDLPCGYEAEDQAKLFPLHQETAAS

SEQ ID NO: 50889 - protein, 963 aa, Homo sapiens
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 50890 - protein, 860 aa, Homo sapiens
GKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 50891 - protein, 725 aa, Homo sapiens
MATYIHVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 50892 - protein, 862 aa, Homo sapiens
MWGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 50893 - protein, 957 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 50894 - protein, 72 aa, Homo sapiens
MADPAECSIKVMCRFRPLNEAEILRGDKFIPKFKGDETVVIGQGKPYVFDRVLPPNTTQEQVYNACAKQIVK

SEQ ID NO: 50895 - protein, 265 aa, Homo sapiens
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 50896 - protein, 814 aa, Homo sapiens
MVKQTIQIFARVKPPVRKHQQGIYSIDEDEKLIPSLEIILPRDLADGFVNNKRESYKFKFQRIFDQDANQETVFENIAKPVAGSVLAGYNGTIFAYGQTGSGKTFTITGGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 50897 - protein, 165 aa, Homo sapiens
MIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLKAPSSSDGVLFCRNQ

SEQ ID NO: 50898 - protein, 653 aa, Homo sapiens
MASSLYDLKKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 50899 - protein, 797 aa, Homo sapiens
MVKQTIQIFARVKPPVRKHQQGIYSIDEDEKLIPSLEIILPRDLADGFVNNKRESYKFKFQRIFDQDANQETVFENIAKPVAGSVLAGYNGTIFAYGQTGSGKTFTITGGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 50900 - protein, 797 aa, Homo sapiens
MVKQTIQIFARVKPPVRKHQQGIYSIDEDEKLIPSLEIILPRDLADGFVNNKRESYKFKFQRIFDQDANQETVFENIAKPVAGSVLAGYNGTIFAYGQTGSGKTFTITGGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSDVNARKILPSPCPSPHSQKQSSTSTPLEDSIPKRPVSSIPLTGDSQTDSDIIAFIKARQSILQKQCLGSN

SEQ ID NO: 50901 - protein, 248 aa, Homo sapiens
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSDVNARKILPSPCPSPHSQKQSSTSTPLEDSIPKRPVSSIPLTGDSQTDSDIIAFIKARQSILQKQCLGSN

SEQ ID NO: 50902 - protein, 161 aa, Homo sapiens
TPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLKAPSSSDGVLFCRNQ

SEQ ID NO: 50903 - protein, 689 aa, Homo sapiens
  MOD_RES (1)..(1): Any amino acid
XGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSDVNARKILPSPCPSPHSQKQSSTSTPLEDSIPKRPVSSIPLTGDSQTDSDIIAFIKARQSILQKQCLGSN

SEQ ID NO: 50904 - protein, 758 aa, Homo sapiens
MVKQTIQIFARVKPPVRKHQQGIYSIDEDEKLIPSLEIILPRDLADGFVNNKRESYKFKFQRIFDQDANQETVFENIAKPVAGSVLAGYNGTIFAYGQTGSGKTFTITGGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEISILSEVMKKLPLSWFERGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 50905 - protein, 171 aa, Homo sapiens
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKSKIKALADSMSGL

SEQ ID NO: 50906 - protein, 293 aa, Homo sapiens
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQYLQLLCSLFPKSAVSSAQASTNRKGLSDVLVTR

SEQ ID NO: 50907 - protein, 1343 aa, Homo sapiens
MGLEAQRLPGAEEAPVRVALRVRPLLPKELLHGHQSCLQVEPGLGRVTLGRDRHFGFHVVLAEDAGQEAVYQACVQPLLEAFFEGFNATVFAYGQTGSGKTYTMGEASVASLLEDEQGIVPRAMAEAFKLIDENDLLDCLVHVSYLEVYKEEFRDLLEVGTASRDIQLREDERGNVVLCGVKEVDVEGLDEVLSLLEMGNAARHTGATHLNHLSSRSHTVFTVTLEQRGRAPSRLPRPAPGQLLVSKFHFVDLAGSERVLKTGSTGERLKESIQINSSLLALGNVISALGDPQRRGSHIPYRDSKITRILKDSLGGNAKTVMIACVSPSSSDFDETLNTLNYASRAQNIRNRATVNWRPEAERPPEETASGARGPPRHRSETRIIHRGRRAPGPATASAAAAMRLGAECARYRACTDAAYSLLRELQAEPGLPGAAARKVRDWLCAVEGERSALSSASGPDSGIESASVEDQAAQGAGGRKEDEGAQQLLTLQNQVARLEEENRDFLAALEDAMEQYKLQSDRLREQQEEMVELRLRLELVRPGWGGPRLLNGLPPGSFVPRPHTAPLGGAHAHVLGMVPPACLPGDEVGSEQRGEQVTNGREAGAELLTEVNRLGSGSSAASEEEEEEEEPPRRTLHLRRNRISNCSQRAGARPGSLPERKGPELCLEELDAAIPGSRAVGGSKARVQARQVPPATASEWRLAQAQQKIRELAINIRMKEELIGELVRTGKAAQALNRQHSQRIRELEQEAEQVRAELSEGQRQLRELEGKELQDAGERSRLQEFRRRVAAAQSQVQVLKEKKQATERLVSLSAQSEKRLQELERNVQLMRQQQGQLQRRLREETEQKRRLEAEMSKRQHRVKELELKHEQQQKILKIKTEEIAAFQRKRRSGSNGSVVSLEQQQKIEEQKKWLDQEMEKVLQQRRALEELGEELHKREAILAKKEALMQEKTGLESKRLRSSQALNEDIVRVSSRLEHLEKELSEKSGQLRQGSAQSQQQIRGEIDSLRQEKDSLLKQRLEIDGKLRQGSLLSPEEERTLFQLDEAIEALDAAIEYKNEAITCRQRVLRASASLLSQCEMNLMAKLSYLSSSETRALLCKYFDKVVTLREEQHQQQIAFSELEMQLEEQQRLVYWLEVALERQRLEMDRQLTLQQKEHEQNMQLLLQQSRDHLGEGLADSRRQYEARIQALEKELGRYMWINQELKQKLGGVNAVGHSRGGEKRSLCSEGRQAPGNEDELHLAPELLWLSPLTEGAPRTREETRDLVHAPLPLTWKRSSLCGEEQGSPEELRQREAAEPLVGRVLPVGEAGLPWNFGPLSKPRRELRRASPGMIDVRKNPL

SEQ ID NO: 50908 - protein, 673 aa, Homo sapiens
MDPQRSPLLEVKGNIELKRPLIKAPSQLPLSGSRLKRRPDQMEDGLEPEKKRTRGLGATTKITTSHPRVPSLTTVPQTQGQTTAQKVSKKTGPRCSTAIATGLKNQKPVPAVPVQKSGTSGVPPMAGGKKPSKRPAWDLKGQLCDLNAELKRCRERTQTLDQENQQLQDQLRDAQQQVKALGTERTTLEGHLAKVQAQAEQGQQELKNLRACVLELEERLSTQEGLVQELQKKQVELQEERRGLMSQLEEKERRLQTSEAALSSSQAEVASLRQETVAQAALLTEREERLHGLEMERRRLHNQLQELKGNIRVFCRVRPVLPGEPTPPPGLLLFPSGPGGPSDPPTRLSLSRSDERRGTLSGAPAPPTRHDFSFDRVFPPGSGQDEVFEEIAMLVQSALDGYPVCIFAYGQTGSGKTFTMEGGPGGDPQLEGLIPRALRHLFSVAQELSGQGWTYSFVASYVEIYNETVRDLLATGTRKGQGGECEIRRAGPGSEELTVTNARYVPVSCEKEVDALLHLARQNRAVARTAQNERSSRSHSVFQLQISGEHSSRGLQCGAPLSLVDLAGSERLDPGLALGPGERERLRETQAINSSLSTLGLVIMALSNKESHVPYRNSKLTYLLQNSLGGSAKMLMFVNISPLEENVSESLNSLRFASKVNQCVIGTAQANRK

SEQ ID NO: 50909 - protein, 203 aa, Homo sapiens
MDPQRSPLLEVKGNIELKRPLIKAPSQLPLSGSRLKRRPDQMEDGLEPEKKRTRGLGATTKITTSHPRVPSLTTVPQTQGQTTGPSSHPLPWQCHHQPFLVTDPGGRSWGPGQKWHRLHLWCTSAQKVSKKTGPRCSTAIATGLKNQKPVPAVPVQKSGTSGVPPMAGGKKPSKRPAWDLKGQLCDLNAELKRCRERTQTLDQ

SEQ ID NO: 50910 - protein, 203 aa, Homo sapiens
MDPQRSPLLEVKGNIELKRPLIKAPSQLPLSGSRLKRRPDQMEDGLEPEKKRTRGLGATTKITTSHPRVPSLTTVPQTQGQTTGPSSHPLPWQCHHQPFLETDPGGRSWGPGQKWHRLHLWCTSAQKVSKKTGPRCSTAIATGLKNQKPVPAVPVQKSGTSGVPPMAGGKKPSKRPAWDLKGQLCDLNAELKRCRERTQTLDQ

SEQ ID NO: 50911 - protein, 673 aa, Homo sapiens; identical to SEQ ID NO: 50908

SEQ ID NO: 50912 - protein, 673 aa, Homo sapiens; identical to SEQ ID NO: 50908

SEQ ID NO: 50913 - protein, 203 aa, Homo sapiens; identical to SEQ ID NO: 50910

SEQ ID NO: 50914 - protein, 833 aa, Homo sapiens
MVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSGKSRPLPV

SEQ ID NO: 50915 - protein, 687 aa, Homo sapiens
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 50916 - protein, 826 aa, Homo sapiens
MVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 50917 - protein, 768 aa, Homo sapiens
MVLRMVEAMSQLQDEKTQLQEELVVLQERLALRDSDQQATSTQLQNQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 50918 - protein, 724 aa, Homo sapiens
MIKVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 50919 - protein, 848 aa, Homo sapiens
MCASACKDTAAWCPEEAAEPQAMVPSRRTWNLGATPSLRGLWRVGRAPEPEPGMARPAPAPASPAARPFPHTGPGRLRTGRGKDTPVCGDEDSSARSAARPALAQCRALSVDWAGPGSPHGLYLTLQVEHLKEKLISQAQEVSRLRSELGGTDLEKHRDLLMVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 50920 - protein, 684 aa, Homo sapiens
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 50921 - protein, 637 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPGMKRASSLNVLNVGGKAAEDRFQERNNCLADSRALSASHTDLAH

SEQ ID NO: 50922 - protein, 639 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPGMKRASSLNVLNVGGKAAEDRFQGVSGRASFCGKRQQQQWPGRRHR

SEQ ID NO: 50923 - protein, 628 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEDGTGSLKRSGSFSKLRASIRRSSEKLVRKLKGGSSRESEPKNPGMKRASSLNVLNVGGKAAEDRFQERNNCLADSRALSASHTDLAH

SEQ ID NO: 50924 - protein, 573 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGGVSGRASFCGKRQQQQWPGRRHR

SEQ ID NO: 50925 - protein, 576 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQRSISEIPKKILSANGSNHFPLPGSQGLDNVHKQRVAEVLNDPENMEKRRSRESLNVDVVKYESGPDGGEEMRKMKLGLVN

SEQ ID NO: 50926 - protein, 560 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGMRKMKLGLVN

SEQ ID NO: 50927 - protein, 584 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEMKRASSLNVLNVGGKAAEDRFQERNNCLADSRALSASHTDLAH

SEQ ID NO: 50928 - protein, 618 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEVSMSVEWNGDGTGSLKRSGSFSKLRASIRRSSEKLVRKLKGGSSRESEPKNPGASLAEPLFVENDSSSSGLEDATAN

SEQ ID NO: 50929 - protein, 560 aa, Homo sapiens; identical to SEQ ID NO: 50926

SEQ ID NO: 50930 - protein, 131 aa, Homo sapiens
  MOD_RES (1)..(1): Any amino acid
XENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEMRKMKLGLVN

SEQ ID NO: 50931 - protein, 630 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEDGTGSLKRSGSFSKLRASIRRSSEKLVRKLKGGSSRESEPKNPGMKRASSLNVLNVGGKAAEDRFQGVSGRASFCGKRQQQQWPGRRHR

SEQ ID NO: 50932 - protein, 150 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEF

SEQ ID NO: 50933 - protein, 564 aa, Homo sapiens
MYDNMSTMVYIKEDKLEKLTQDEIISKTKQVIQGLEALKNEHNSILQSLLETLKCLKKDDESNLVEEKSNMIRKSLEMLELGLSEAQVMMALSNHLNAVESEKQKLRAQVRRLCQENQWLRDELANTQQKLQKSEQSVAQLEEEKKHLEFMNQLKKYDDDISPSEDKDTDSTKEPLDDLFPNDEDDPGQGIQQQHSSAAAAAQQGGYEIPARLRTLHNLVIQYASQGRYEVAVPLCKQALEDLEKTSGHDHPDVATMLNILALVYRDQNKYKDAANLLNDALAIREKTLGKDHPAVAATLNNLAVLYGKRGKYKEAEPLCKRALEIREKVLGKDHPDVAKQLNNLALLCQNQGKYEEVEYYYQRALEIYQTKLGPDDPNVAKTKNNLASCYLKQGKFKQAETLYKEILTRAHEREFGSVDDENKPIWMHAEEREECKGKQKDGTSFGEYGGWYKACKVDSPTVTTTLKNLGALYRRQGKFEAAETLEEAAMRSRKQGLDNVHKQRVAEVLNDPENMEKRRSRESLNVDVVKYESGPDGGEEGVSGRASFCGKRQQQQWPGRRHR

SEQ ID NO: 50934 - protein, 622 aa, Homo sapiens
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 50935 - protein, 545 aa, Homo sapiens
MAMMVFPREEKLSQDEIVLGTKAVIQGLETLRGEHRALLAPLVAPEAGEAEPGSQERCILLRRSLEAIELGLGEAQEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDALAIREKTLGKDHPAVAATLNNLAVLYGKRGKYKEAEPLCKRALEIREKVLGKFHPDVAKQLSNLALLCQNQGKAEEVEYYYRRALEIYATRLGPDDPNVAKTKNNLASCYLKQGKYQDAETLYKEILTRAHEKEFGSVNGDNKPIWMHAEEREESKDKRRDSAPYGEYGSWYKACKVDSPTVNTTLRSLGALYRRQGKLEAAHTLEDCASRNRKQGLDPASQTKVVELLKDGSGRRGDRRSSRDMAGGAGPRSESDLEDVGPTAEWNGDGSGSLRRSGSFGKLRDALRRSSEMLVKKLQGGTPQEPPNPRMKRASSLNFLNKSVEEPTQPGGTGLSDSRTLSSSSMDLSRRSSLVG

SEQ ID NO: 50936 - protein, 622 aa, Homo sapiens; identical to SEQ ID NO: 50934

SEQ ID NO: 50937 - protein, 622 aa, Homo sapiens; identical to SEQ ID NO: 50934

SEQ ID NO: 50938 - protein, 545 aa, Homo sapiens; identical to SEQ ID NO: 50935

SEQ ID NO: 50939 - protein, 166 aa, Homo sapiens
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDD

SEQ ID NO: 50940 - protein, 189 aa, Homo sapiens
MAMMVFPREEKLSQDEIVLGTKAVIQGLETLRGEHRALLAPLVAPEAGEAEPGSQERCILLRRSLEAIELGLGEAQEEKGDVPKDTLDDLFPNEDEQSPAPSPGGGDVSGQHGGYEIPARLRTLHNLVIQYASQGRYEVAVPLCKQALEDLEKTSGHDHPDVATMLNILALVYRDQNKYKEAAHLLNDA

SEQ ID NO: 50941 - protein, 171 aa, Homo sapiens
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRKLDEDASPNEEKGDVPKDTLDDLFPNE

SEQ ID NO: 50942 - protein, 145 aa, Homo sapiens
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQENQWLREELAGTQQKLQRSEQAVAQLEEEKQHLLFMSQIRK

SEQ ID NO: 50943 - protein, 105 aa, Homo sapiens
MAMMVFPREEKLSQDEIVLGTKAVIQGLETLRGEHRALLAPLVAPEAGEAEPGSQERCILLRRSLEAIELGLGEAQVILALSSHLGAVESEKQKLRAQVRRLVQE

SEQ ID NO: 50944 - protein, 504 aa, Homo sapiens
MSVQVAAPGSAGLGPERLSPEELVRQTRQVVQGLEALRAEHHGLAGHLAEALAGQGPAAGLEMLEEKQQVVSHSLEAIELGLGEAQVLLALSAHVGALEAEKQRLRSQARRLAQENVWLREELEETQRRLRASEESVAQLEEEKRHLEFLGQLRQYDPPAESQQSESPPRRDSLASLFPSEEEERKGPEAAGAAAAQQGGYEIPARLRTLHNLVIQYAGQGRYEVAVPLCRQALEDLERSSGHCHPDVATMLNILALVYRDQNKYKEATDLLHDALQIREQTLGPEHPAVAATLNNLAVLYGKRGRYREAEPLCQRALEIREKVLGADHPDVAKQLNNLALLCQNQGKFEDVERHYARALSIYEALGGPHDPNVAKTKNNLASAYLKQNKYQQAEELYKEILHKEDLPAPLGAPNTGTAGDAEQALRRSSSLSKIRESIRRGSEKLVSRLRGEAAAGAAGMKRAMSLNTLNVDAPRAPGTQFPSWHLDKAPRTLSASTQDLSPH

SEQ ID NO: 50945 - protein, 518 aa, Homo sapiens
MIPQTPHHCSPGAAMSVQVAAPGSAGLGPERLSPEELVRQTRQVVQGLEALRAEHHGLAGHLAEALAGQGPAAGLEMLEEKQQVVSHSLEAIELGLGEAQVLLALSAHVGALEAEKQRLRSQARRLAQENVWLREELEETQRRLRASEESVAQLEEEKRHLEFLGQLRQYDPPAESQQSESPPRRDSLASLFPSEEEERKGPEAAGAAAAQQGGYEIPARLRTLHNLVIQYAGQGRYEVAVPLCRQALEDLERSSGHCHPDVATMLNILALVYRDQNKYKEATDLLHDALQIREQTLGPEHPAVAATLNNLAVLYGKRGRYREAEPLCQRALEIREKVLGADHPDVAKQLNNLALLCQNQGKFEDVERHYARALSIYEALGGPHDPNVAKTKNNLASAYLKQNKYQQAEELYKEILHKEDLPAPLGAPNTGTAGDAEQALRRSSSLSKIRESIRRGSEKLVSRLRGEAAAGAAGMKRAMSLNTLNVDAPRAPGTQFPSWHLDKAPRTLSASTQDLSPH

SEQ ID NO: 50946 - protein, 792 aa, Homo sapiens
MQGEDARYLKRKVKGGNIDVHPSEKALIVHYEVEATILGEMGDPMLGERKECQKIIRLKSLNANTDITSLARKVVEECKLIHPSKLNEVEQLLYYLQNRRDSLSGKEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 50947 - protein, 752 aa, Homo sapiens
MGDPMLGERKECQKIIRLKSLNANTDITSLARKVVEECKLIHPSKLNEVEQLLYYLQNRRDSLSGKEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 50948 - protein, 748 aa, Homo sapiens
MQGEDARYLKSIRLKSLNANTDITSLARKVVEECKLIHPSKLNEVEQLLYYLQNRRDSLSGKEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 50949 - protein, 714 aa, Homo sapiens
MSIALGNTYRRSLSDSETVSVLQASLCEEKKEKSSKPKDPPPFEGMEIDEVANINDMDEYIELLYEDIPDKVRGSALILQLARNPDNLEELLLNETALGALARVLREDWKQSVELATNIIYIFFCFSSFSQFHGLITHYKIGALCMNIIDHELKRHELWQEELSKKKKAVDEDPENQTLRKDYEKTFKKYQGLVVKQEQLLRVALYLLLNLAEDTRTELKMRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 50950 - protein, 494 aa, Homo sapiens
MRNKNIVHMLVKALDRDNFELLILVVSFLKKLSIFMENKNDMVEMDIVEKLVKMIPCEHEDLLNITLRLLLNLSFDTGLRNKMVQVGLLPKLTALLGNDNYKQIAMCVLYHISMDDRFKSMFAYTDCIPQLMKMLFECSDERIDLELISFCINLAANKRNVQLICEGNGLKMLMKRALKFKDPLLMKMIRNISQHDGPTKNLFIDYVGDLAAQISNDEEEEFVIECLGTLANLTIPDLDWELVLKEYKLVPYLKDKLKPGAAEDDLVLEVVIMIGTVSMDDSCAALLAKSGIIPALIELLNAQQEDDEFVCQIIYVFYQMVFHQATRDVIIKETQAPAYLIDLMHDKNNEIRKVCDNTLDIIAEYDEEWAKKIQSEKFRWHNSQWLEMVESRQMDESEQYLYGDDRIEPYIHEGDILERPDLFYNSDGLIASEGAISPDFFNDYHLQNGDVVGQHSFPGSLGMDGFGQPVGILGRPATAYGFRPDEPYYYGYGS

SEQ ID NO: 50951 - protein, 644 aa, Homo sapiens
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPIQSDDDWIPDIQIDPNGLSFNPISDFPDTTSPKCPGRPWKSVSEINPTTQMKESYYFDLTDGLS

SEQ ID NO: 50952 - protein, 427 aa, Homo sapiens
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 50953 - protein, 415 aa, Homo sapiens [sequence omitted]

SEQ ID NO: 50954 - protein, 391 aa, Homo sapiens
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 50955 - protein, 101 aa, Homo sapiens
MDIPISSRDFRGLQLACVALGLVAGSIIIGISVSKAAAAMGGVFIGAAVLGSLRIHPHPGADHGEGRSSTNGNKEGARSSLSTVSRTLEKLKPGTRGAEEC

SEQ ID NO: 50956 - protein, 124 aa, Homo sapiens
MDIPISSRDFRGLQLACVALGLVAGSIIIGISVSKAAAAMGGVFIGAAVLGLLILAYPFLKARFNLDHILPTIGSLRIHPHPGADHGEGRSSTNGNKEGARSSLSTVSRTLEKLKPGTRGAEEC

SEQ ID NO: 50957 - protein, 1044 aa, Homo sapiens
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDRQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 50958 - protein, 462 aa, Homo sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPLRRRSCLLAPGKGPPALGASRGPRRSWAVWYQQPRGVALPCSPGDPQAEGSAAGYRPLSASSQSSLRSLISAL

SEQ ID NO: 50959 - protein, 420 aa, Homo sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGGAVCWLREKGPRRWGLPGAPGEAGLCGTNSPEGWPCPAPPGTPRLRVLPRATGL

SEQ ID NO: 50960 - protein, 423 aa, Homo sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPLRRRSCLLAPGKGPPALGASRGPRRSWAVWYQQPRGVALPCSPGDPQAEGSAAGYRPLSASSQSSLRSLISAL

SEQ ID NO: 50961 - protein, 381 aa, Homo sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGGAVCWLREKGPRRWGLPGAPGEAGLCGTNSPEGWPCPAPPGTPRLRVLPRATGL

SEQ ID NO: 50962 - protein, 736 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKERQWVDDFPLHRSACEGDSELLSRLLSERFSVNQLDSDHWAPIHYACWYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 50963 - protein, 381 aa, Homo sapiens
MASPSLERPEKGAGKSEFRNQKPKPENQDESELLTVPDGWKEPAFSKEDNPRGLLEESSFATLFPKYREAYLKECWPLVQKALNEHHVNATLDLIEGSMTVCTTKKTFDPYIIIRARDLIKLLARSVSFEQAVRILQDDVACDIIKIGSLVRNKERFVKRRQRLIGPKGSTLKALELLTNCYIMVQGNTVSAIGPFSGLKEVRKVVLDTMKNIHPIYNIKSLMIKRELAKDSELRSQSWERFLPQFKHKNVNKRKEPKKKTVKKEYTPFPPPQPESQIDKELASGEYFLKANQKKRQKMEAIKAKQAEAISKRQEERNKAFIPPKEKPIVKPKEASTETKIDVASIKEKVKKAKNKKLGALTAEEIALKMEADEKKKKKKK

SEQ ID NO: 50964 - protein, 512 aa, Homo sapiens
MHTPDFAGPDDARAVDIMDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVLQSSAVVARALSGGAERGLLGLEPVPSSPCRAKGTSVIRHTGESPAACFPTIQTPDCRLSDSREGEEQLLGHFETLQDTHLTDSLLSTNLVSCQPCLHKSGGLLLTDKGQQAGWPGAVQTCSPKNYENDLPRKTTPLISVSVPAPPVLCQMIPVTGQSSMLPAFLKPPPQLSVGTVRPILAQAAPAPQPVFVGPAVPQGAVMLVLPQGALPPPAPCAANVMAAGNTKLLPLAPAPVFITSSQNCVPQVDFSRRRNYVCSFPGCRKTYFKSSHLKAHLRTHTGEKPFNCSWDGCDKKFARSDELSRHRRTHTGEKKFVCPVCDRRFMRSDHLTKHARRHMTTKKIPGWQAEVGKLNRIASAESPGSPLVSMPASA

SEQ ID NO: 50965 - protein, 495 aa, Homo sapiens
MDICESILERKRHDSERSTCSILEQTDMEAVEALVCMSSWGQRSQKGDLLRIRPLTPVSDSGDVTTTVHMDAATPELPKDFHSLSTLCITPPQSPDLVEPSTRTPVSPQVTDSKACTATDVLQSSAVVARALSGGAERGLLGLEPVPSSPCRAKGTSVIRHTGESPAACFPTIQTPDCRLSDSREGEEQLLGHFETLQDTHLTDSLLSTNLVSCQPCLHKSGGLLLTDKGQQAGWPGAVQTCSPKNYENDLPRKTTPLISVSVPAPPVLCQMIPVTGQSSMLPAFLKPPPQLSVGTVRPILAQAAPAPQPVFVGPAVPQGAVMLVLPQGALPPPAPCAANVMAAGNTKLLPLAPAPVFITSSQNCVPQVDFSRRRNYVCSFPGCRKTYFKSSHLKAHLRTHTGEKPFNCSWDGCDKKFARSDELSRHRRTHTGEKKFVCPVCDRRFMRSDHLTKHARRHMTTKKIPGWQAEVGKLNRIASAESPGSPLVSMPASA

SEQ ID NO: 50966 - protein, 495 aa, Homo sapiens; identical to SEQ ID NO: 50965

SEQ ID NO: 50967 - protein, 402 aa, Homo sapiens
ISVHLMRKHVKNINTFENRMLMLDGMPAVRVKTELLESEQGSPNVHNYPDMEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQEVHPSPVSRVRGNRMNNQKFPCSISPFSIESTRRQRRSESPDSRKRRIHRCDFEGCNKVYTKSSHLKAHRRTHTGEKPYKCTWEGCTWKFARSDELTRHYRKHTGVKPFKCADCDRSFSRSDHLALHRRRHMLV

SEQ ID NO: 50968 - protein, 402 aa, Homo sapiens
MNIHMKRKTIKNINTFENRMLMLDGMPAVRVKTELLESEQGSPNVHNYPDMEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQEVHPSPVSRVRGNRMNNQKFPCSISPFSIESTRRQRRSESPDSRKRRIHRCDFEGCNKVYTKSSHLKAHRRTHTGEKPYKCTWEGCTWKFARSDELTRHYRKHTGVKPFKCADCDRSFSRSDHLALHRRRHMLV

SEQ ID NO: 50969 - protein, 402 aa, Homo sapiens; identical to SEQ ID NO: 50968

SEQ ID NO: 50970 - protein, 288 aa, Homo sapiens
MAAAAYVDHFAAECLVSMSSRAVVHGPREGPESRPEGAAVAATPTLPRVEERRDGKDSASLFVVARILADLNQQAPAPAPAERREGAAARKARTPCRLPPPAPEPTSPGAEGAAAAPPSPAWSEPEPEAGLEPEREPGPAGSGEPGLRQRVRRGRSRADLESPQRKHKCHYAGCEKVYGKSSHLKAHLRTHTGERPFACSWQDCNKKFARSDELARHYRTHTGEKKFSCPICEKRFMRSDHLTKHARRHANFHPGMLQRRGGGSRTGSLSDYSRSDASSPTISPASSP

SEQ ID NO: 50971 - protein, 416 aa, Homo sapiens
MVDHLLPVDENFSSPKCPVGYLGDRLVGRRAYHMLPSPVSEDDSDASSPCSCSSPDSQALCSCYGGGLGTESQDSILDFLLSQATLGSGGGSGSSIGASSGPVAWGPWRRAAAPVKGEHFCLPEFPLGDPDDVPRPFQPTLEEIEEFLEENMEPGVKEVPEGNSKDLDACSQLSAGPHKSHLHPGSSGRERCSPPPGGASAGGAQGPGGGPTPDGPIPVLLQIQPVPVKQESGTGPASPGQAPENVKVAQLLVNIQGQTFALVPQVVPSSNLNLPSKFVRIAPVPIAAKPVGSGPLGPGPAGLLMGQKFPKNPAAELIKMHKCTFPGCSKMYTKSSHLKAHLRRHTGEKPFACTWPGCGWRFSRSDELSRHRRSHSGVKPYQCPVCEKKFARSDHLSKHIKVHRFPRSSRSVRSVN

SEQ ID NO: 50972 - protein, 355 aa, Homo sapiens
MALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAARGLLTPPASPLELLEAKPKRGRRSWPRKRTATHTCSYAGCGKTYTKSSHLKAHLRTHTGEKPYHCNWDGCGWKFARSDELTRHYRKHTGHRPFQCHLCDRAFSRSDHLALHMKRHM

SEQ ID NO: 50973 - protein, 77 aa, Homo sapiens
MDVLPMCSIFQELQIVHETGYFSALPSLEEYWQQTCLELERYLQSEPCYVSASEIKFDSQESVDQNHWLGRKRRNPN

SEQ ID NO: 50974 - protein, 281 aa, Homo sapiens
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGQCPRGPRRAAAGGRHCIAPALEGAGPGCTGCGQGRQILTSSDVFHQSIRSFWSSE

SEQ ID NO: 50975 - protein, 283 aa, Homo sapiens
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGEKPYRCSWEGCEWRFARSDELTRHFRKHTGAKPFKCSHCDRCFSRSDHLALHMKRHL

SEQ ID NO: 50976 - protein, 237 aa, Homo sapiens
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGVFPGLTTWPCT

SEQ ID NO: 50977 - protein, 302 aa, Homo sapiens
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGEKPYKCSWEGCEWRFARSDELTRHYRKHTGAKPFKCNHCDRCFSRSDHLALHMKRHI

SEQ ID NO: 50978 - protein, 274 aa, Homo sapiens
MFPSWPTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGEKPYKCSWEGCEWRFARSDELTRHYRKHTGAKPFKCNHCDRCFSRSDHLALHMKRHI

SEQ ID NO: 50979 - protein, 269 aa, Homo sapiens
MTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGEKPYKCSWEGCEWRFARSDELTRHYRKHTGAKPFKCNHCDRCFSRSDHLALHMKRHI

SEQ ID NO: 50980 - protein, 112 aa, Homo sapiens
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSL

SEQ ID NO: 50981 - protein, 60 aa, Homo sapiens
MDVLASYSIFQELQLVHDTGYFSALPSLEETWQQTCLELERYLQTEPRRISETFGEDLDC

SEQ ID NO: 50982 - protein, 112 aa, Homo sapiens
MDVLASYSIFQELQLVHDTGYFSALPSLEETWQQTCLELERYLQTEPRRISETFGEKPYKCSWEGCEWRFARSDELTRHYRKHTGAKPFKCNHCDRCFSRSDHLALHMKRHI

SEQ ID NO: 50983 - protein, 257 aa, Homo sapiens
MVDMDKLINNLEVQLNSEGGSMQVFKQVTASVRNRDPPEIEYRSNMTSPTLLDANPMENPALFNDIKIEPPEELLASDFSLPQVEPVDLSFHKPKAPLQPASMLQAPIRPPKPQSSPQTLVVSTSTSDMSTSANIPTVLTPGSVLTSSQSTGSQQILHVIHTIPSVSLPNKMGGLKTIPVVVQSLPMVYTTLPADGGPAAITVPLIGGDGKNAGSVKVDPTSMSPLEIPSDSEESTIESGSSALQSLQGLQQEREAL

SEQ ID NO: 50984 - protein, 359 aa, Homo sapiens
MVDMDKLINNLEVQLNSEGGSMQVFKQVTASVRNRDPPEIEYRSNMTSPTLLDANPMENPALFNDIKIEPPEELLASDFSLPQVEPVDLSFHKPKAPLQPASMLQAPIRPPKPQSSPQTLVVSTSTSDMSTSANIPTVLTPGSVLTSSQSTGSQQILHVIHTIPSVSLPNKMGGLKTIPVVVQSLPMVYTTLPADGGPAAITVPLIGGDGKNAGSVKVDPTSMSPLEIPSDSEESTIESGSSALQSLQGLQQEPAAMAQMQGEESLDLKRRRIHQCDFAGCSKVYTKSSHLKAHRRIHTGEKPYKCTWDGCSWKFARSDELTRHFRKHTGIKPFRCTDCNRSFSRSDHLSLHRRRHDTM

SEQ ID NO: 50985 - protein, 256 aa, Homo sapiens
MQPAKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 50986 - protein, 234 aa, Homo sapiens
MQPRKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 50987 - protein, 230 aa, Homo sapiens
MGIQGMELCAMAVVVLLFIAVLKQFGILEPISMEDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 50988 - protein, 188 aa, Homo sapiens
MATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 50989 - protein, 225 aa, Homo sapiens
MSGCRKRCKREILKFAQYLLRLLTGSLHTDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 50990 - protein, 229 aa, Homo sapiens
MNLEGLEMIAVLIVIVLFVKLLEQFGLIEAGLEDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 50991 - protein, 250 aa, Homo sapiens
MNVRRVESISAQLEEASSTGGFLYAQNSTKRSIKERLMKLLPCSAAKTSSPAIQNSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 50992 - protein, 188 aa, Homo sapiens; identical to SEQ ID NO: 50988

SEQ ID NO: 50993 - protein, 216 aa, Homo sapiens
MNVRRVESISAQLEEASSTGDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 50994 - protein, 188 aa, Homo sapiens; identical to SEQ ID NO: 50988

SEQ ID NO: 50995 - protein, 182 aa, Homo sapiens
  MOD_RES (1)..(1): Any amino acid
XGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISRLLSHSEILQT

SEQ ID NO: 50996 - protein, 452 aa, Homo sapiens
MDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 50997 - protein, 473 aa, Homo sapiens
MDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 50998 - protein, 486 aa, Homo sapiens
MDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 50999 - protein, 562 aa, Homo sapiens
MELKKDINAVSIDMLLIVHSEKRRAAQGTLSDQQANPSSLLQRGGGFQGVGNGVRRWQKLEGNDFHENLVEKQHPQQPQVITSYNSQGTQLTVEVHPRDAMPQLLKKFSLAKRLQGDKNGNTRPRQPGGKDAHAYPWDRSSLKSMSLDLQQFEKLDIYASQVTAKSGLDELVSDLLQEAHTDLERVRAIWIWICHHIEYDIAAAQEKDRQAFKPTDILRTQKTNCDGYAGLFERMCRLAGVQCMTVPGYSKGFGYQTGQSFSGEFDHAWNAVYLEGRWHLVDSTWGSGLVDTITSKFTFLYNEFYFLTHPALFIEDHFPDNKNWQLLKPPQSLRQFENNMYHKSEFYNKGMLSAHPETSMIRTVNGKATVTIESCAPTLFMFMLNGKQEHGLLSLRKNGMKLEVYPPTMGTHKLQIFAKGNSDIYSSVLEYTLKCNYVDMGVQLPAELHQPVGPSWFSEQMGIMKPSHPDPIIHTSDGRCSISFSVEEGINVLASLHGDDGPITEETQRRYIFQLHREKQTELKVQLPHAGKFALKEVYVMVLENANHNFYSYILKYKVNAQ

SEQ ID NO: 51000 - protein, 661 aa, Homo sapiens
MELKKDINAVSIDMLLIVHSEKRRAAQGTLSDQQANPSSLLQRGGGFQGVGNGVRRWQKLEGNDFHENLVEKQHPQQPQVITSYNSQGTQLTVEVHPRDAMPQLLKKFSLAKRLQGDKNGNTRPRQPGGKDAHAYPWDRSSLKSMSLDLQQFEKLDIYASQVTAKSGLDELVSDLLQEAHTDLERVRAIWIWICHHIEYDIAAAQEKDRQAFKPTDILRTQKTNCDGYAGLFERMCRLAGVQCMTVPGYSKGFGYQTGQSFSGEFDHAWNAVYLEGRWHLVDSTWGSGLVDTITSKFTFLYNEFYFLTHPALFIEDHFPDNKNWQLLKPPQSLRQFENNMYHKSEFYNKGMLSAHPETSMIRTVNGKATVTIESCAPTLFMFMLNGKQEHGLLSLRKNGMKLEVYPPTMGTHKLQIFAKGNSDIYSSVLEYTLKCNYVDMGVQLPAELHQPVGPSWFSEQMGIMKPSHPDPIIHTSDGRCSISFSVEEGINVLASLHGDDGPITEETQRRYIFQLHREKQTELKVQLPHAGKFALKIFVKKRQEPGNYIFVFNYLVCCANTKVNWPMFPESFGNWGQDNELLEPLSGVLPANRNVPFKLKLHGIAKVLVKGQDTWPLTLNHEGYWEGSCSTAGCQEVYVMVLENANHNFYSYILKYKVNAQ

SEQ ID NO: 51001 - protein, 390 aa, Homo sapiens
MKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEVRCKCRVGDRAGVTVLKTAGSRCPPQRHFC

SEQ ID NO: 51002 - protein, 743 aa, Homo sapiens
MRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRLFFPRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEVRCKCRVGDRAGVTVLKTAGSRCPPQRHFC

SEQ ID NO: 51003 - protein, 772 aa, Homo sapiens
MRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEARIVRVTHVSGKTLVWTVAQLGDLVCSDHLQEGKGILETGVHSLLCSLPTHLLAKLSFASDSQY

SEQ ID NO: 51004 - protein, 840 aa, Homo sapiens
MHLVAGDSPGSGPHLPATAFIIPASSATLGLPSSALDVSCFPREPIHVGAPEQVAGCEPVSATVLPQLSAGPASSSTSTVRLLEWTEAAAPPPGGGLRFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEARIVRVTHVSGKTLVWTVAQLGDLVCSDHLQEGKGILETGVHSLLCSLPTHLLAKLSFASDSQY

SEQ ID NO: 51005 - protein, 538 aa, Homo sapiens
QKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEMIDGEAFLLLTQADIVKIMSVKLGPALKIYNAILMFKNADDTLK

SEQ ID NO: 51006 - protein, 840 aa, Homo sapiens; identical to SEQ ID NO: 51004

SEQ ID NO: 51007 - protein, 84 aa, Homo sapiens
MAGVEQPPSPELRQEGVTEYEDGGAPAGDGEAGPQQAEDHPQNPPEDPNQDPPEDDSTCQCQACGPHQAAGPDLGSSNDGCPQL

SEQ ID NO: 51008 - protein, 138 aa, Homo sapiens
MHLVAGDSPGSGPHLPATAFIIPASSATLGLPSSALDVSCFPREPIHVGAPEQVAGCEPVSATVLPQLSAGPASSSTSTVRLLEWTEAAAPPPGGGLRFRISEYKPLNMAGVEQPPSPELRQEGVTEYEDGGAPAGDG

SEQ ID NO: 51009 - protein, 738 aa, Homo sapiens
MRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEVRCKCRVGDRAGVTVLKTAGSRCPPQRHFC

SEQ ID NO: 51010 - protein, 289 aa, Homo sapiens
  MOD_RES (1)..(1): Any amino acid
XTSGSMPTPLTFTLLAGSRRRATSCSLPKSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEAS

SEQ ID NO: 51011 - protein, 705 aa, Homo sapiens
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAEPATPLKAKEATKKKKKQFGKKRKRIPPTKTRPLRQGSKKPLLEDDPQGARKISSEPVPGEIIAVRVKEEHLDVASPDKASSPELPVSVENIKQETDD

SEQ ID NO: 51012 - protein, 288 aa, Homo sapiens
  MOD_RES (1)..(1): Any amino acid
XRPHLQNQWRKRKMTTWSCLVAMIVSGVITAVWAVRAAPIWRSQVKQKMRIGKQGNCRPPRCICSALGLLAPWMAVVLSQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKVGSEPLTDVPPSALPFFCILHATHWS

SEQ ID NO: 51013 - protein, 1253 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 51014 - protein, 1248 aa, Homo sapiens
MVVALRYVWPLLLCSPCLLIQIPEELMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 51015 - protein, 1248 aa, Homo sapiens; identical to SEQ ID NO: 51014

SEQ ID NO: 51016 - protein, 1257 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 51017 - protein, 1257 aa, Homo sapiens; identical to SEQ ID NO: 51016

SEQ ID NO: 51018 - protein, 151 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEG

SEQ ID NO: 51019 - protein, 84 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGV

SEQ ID NO: 51020 - protein, 1255 aa, Homo sapiens
MVVALRYVWPLLLCSPCLLIQIPEESFPGHRVVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 51021 - protein, 116 aa, Homo sapiens
MAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPT

SEQ ID NO: 51022 - protein, 1259 aa, Homo sapiens
MVVALRYVWPLLLCSPCLLIQIPEESFPGHRVVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 51023 - protein, 441 aa, Homo sapiens
MVPALRYLVGACGRARGLFAGGSPGACGFASGRPRPLCGGSRSASTSSFDIVIVGGGIVGLASARALILRHPSLSIGVLEKEKDLAVHQTGHNSGVIHSGIYYKPESLKAKLCVQGAALLYEYCQQKGISYKQCGKLIVAVEQEEIPRLQALYEKGLQNGVPGLRLIQQEDIKKKEPYCRGLMAIDCPHTGIVDYRQVALSFAQDFQEAGGSVLTNFEVKGIEMAKESPSRSIDGMQYPIVIKNTKGEEIRCQYVVTCAGLYSDRISELSGCTPDPRIVPFRGDYLLLKPEKCYLVKGNIYPVPDSRFPFLGVHFTPRMDGSIWLGPNAVLAFKREGYRPFDFSATDVMDIIINSGLIKLASQNFSYGVTEMYKACFLGATVKYLQKFIPEITISDILRQVAVRGPSWLWQQPMKVSDNNIYCFLWRCFALLLTGSACSFK

SEQ ID NO: 51024 - protein, 463 aa, Homo sapiens
MVPALRYLVGACGRARGLFAGGSPGACGFASGRPRPLCGGSRSASTSSFDIVIVGGGIVGLASARALILRHPSLSIGVLEKEKDLAVHQTGHNSGVIHSGIYYKPESLKAKLCVQGAALLYEYCQQKGISYKQCGKLIVAVEQEEIPRLQALYEKGLQNGVPGLRLIQQEDIKKKEPYCRGLMAIDCPHTGIVDYRQVALSFAQDFQEAGGSVLTNFEVKGIEMAKESPSRSIDGMQYPIVIKNTKGEEIRCQYVVTCAGLYSDRISELSGCTPDPRIVPFRGDYLLLKPEKCYLVKGNIYPVPDSRFPFLGVHFTPRMDGSIWLGPNAVLAFKREGYRPFDFSATDVMDIIINSGLIKLASQNFSYGVTEMYKACFLGATVKYLQKFIPEITISDILRGPAGVRAQALDRDGNLVEDFVFDAGVGDIGNRILHVRNAPSPAATSSIAISGMIADEVQQRFEL

SEQ ID NO: 51025 - protein, 463 aa, Homo sapiens; identical to SEQ ID NO: 51024

SEQ ID NO: 51026 - protein, 1019 aa, Homo sapiens
MLWRVLLSKRPPFPHPELDFQEAPIPSCPGRLPGRKNSVALAAAPRKEPTGDREKPLPFPVLAPFSNPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 51027 - protein, 816 aa, Homo sapiens
MATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPR

SEQ ID NO: 51028 - protein, 93 aa, Homo sapiens
MKEQEKGEGSDSKESPKTKSDESGEEKNGDEDCQRGGQKKKGNKHKWVPLQIDMKPEVPREKLASRPTRPPEPRHIPANRGEIKGSESATYVP

SEQ ID NO: 51029 - protein, 611 aa, Homo sapiens [sequence omitted]

SEQ ID NO: 51030 - protein, 582 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 51031 - protein, 582 aa, Homo sapiens; identical to SEQ ID NO: 51030

SEQ ID NO: 51032 - protein, 299 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSS

SEQ ID NO: 51033 - protein, 129 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYV

SEQ ID NO: 51034 - protein, 119 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERP

SEQ ID NO: 51035 - protein, 589 aa, Homo sapiens
MIPNIEGMETESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRDIEISTEEEKDTGDLKDSSLLKTKRKHKKKHKERHKMGEEVIPLRVLSKSEWMDLKKEYLALQKASMASLKKTISQIKSESEMETDSGVPQNTGMKNEKTANREECRTQEKVNATGPQFVSGVIVKIISTEPLPGRKQVRDTLAAISEVLYVDLLEGDTECHARFKTPEDAQAVINAYTEINKKHCWKLEILSGDHEQRYWQKILVDRQAKLNQPREKKRGTEKLITKAEKIRLAKTQQASKHIRFSEYD

SEQ ID NO: 51036 - protein, 138 aa, Homo sapiens
MKFTTLLFLAAVAGALVYAEDASSDSTGADPAQEAGTSKPNEEISGPAEPASPPETTTTAQETSAAAVQGTAKVTSSRQELNPLKSIVEKSILLTEQALAKAGKGMHGGVPGGKQFIENGSEFAQKLLKKFSLLKPWA

SEQ ID NO: 51037 - protein, 142 aa, Homo sapiens
MRFFVPLFLVGILFPAILAKQFTKCELSQLLKDIDGYGGIALPELICTMFHTSGYDTQAIVENNESTEYGLFQISNKLWCKSSQVPQSRNICDISCDKFLDDDITDDIMCAKKILDIKGIDYWLAHKALCTEKLEQWLCEKL

SEQ ID NO: 51038 - protein, 547 aa, Homo sapiens
MYRLMSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKNDFEQGELYLREKFENSIESLRLFKNDPLFFKPGSQFLYSTFGYTLLAAIVERASGCKYLDYMQKIFHDLDMLTTVQEENEPVIYNRARFYVYNKKKRLVNTPYVDNSYKWAGGGFLSTVGDLLKFGNAMLYGYQVGLFKNSNENLLPGYLKPETMVMMWTPVPNTEMSWDKEGKYAMAWGVVERKQTYGSCRKQRHYASHTGGAVGASSVLLVLPEELDTETINNKVPPRGIIVSIICNMQSVGLNSTALKIALEFDKDRSD

SEQ ID NO: 51039 - protein, 373 aa, Homo sapiens
MYRLMSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKNDFEQGELYLREKFENSIESLRLFKNDPLFFKPGSQFLYSTFGYTLLAAIVERASGCKYLDYMQKIFHDLDMLTTVQEENEPVIYNRAR

SEQ ID NO: 51040 - protein, 1927 aa, Homo sapiens
MELSWHVVFIALLSFSCWGSDWESDRNFISTAGPLTNDLLHNLSGLLGDQSSNFVAGDKDMYVCHQPLPTFLPEYFSSLHASQITHYKVFLSWAQLLPAGSTQNPDEKTVQCYRRLLKALKTARLQPMVILHHQTLPASTLRRTEAFADLFADYATFAFHSFGDLVGIWFTFSDLEEVIKELPHQESRASQLQTLSDAHRKAYEIYHESYAFQGGKLSVVLRAEDIPELLLEPPISALAQDTVDFLSLDLSYECQNEASLRQKLSKLQTIEPKVKVFIFNLKLPDCPSTMKNPASLLFSLFEAINKDQVLTIGFDINEFLSCSSSSKKSMSCSLTGSLALQPDQQQDHETTDSSPASAYQRIWEAFANQSRAERDAFLQDTFPEGFLWGASTGAFNVEGGWAEGGRGVSIWDPRRPLNTTEGQATLEVASDSYHKVASDVALLCGLRAQVYKFSISWSRIFPMGHGSSPSLPGVAYYNKLIDRLQDAGIEPMATLFHWDLPQALQDHGGWQNESVVDAFLDYAAFCFSTFGDRVKLWVTFHEPWVMSYAGYGTGQHPPGISDPGVASFKVAHLVLKAHARTWHHYNSHHRPQQQGHVGIVLNSDWAEPLSPERPEDLRASERFLHFMLGWFAHPVFVDGDYPATLRTQIQQMNRQCSHPVAQLPEFTEAEKQLLKGSADFLGLSHYTSRLISNAPQNTCIPSYDTIGGFSQHVNHVWPQTSSSWIRVVPWGIRRLLQFVSLEYTRGKVPIYLAGNGMPIGESENLFDDSLRVDYFNQYINEVLKAIKEDSVDVRSYIARSLIDGFEGPSGYSQRFGLHHVNFSDSSKSRTPRKSAYFFTSIIEKNGFLTKGAKRLLPPNTVNLPSKVRAFTFPSEVPSKAKVVWEKFSSQPKFERDLFYHGTFRDDFLWGVSSSAYQIEGAWDADGKGPSIWDNFTHTPGSNVKDNATGDIACDSYHQLDADLNMLRALKVKAYRFSISWSRIFPTGRNSSINSHGVDYYNRLINGLVASNIFPMVTLFHWDLPQALQDIGGWENPALIDLFDSYADFCFQTFGDRVKFWMTFNEPMYLAWLGYGSGEFPPGVKDPGWAPYRIAHAVIKAHARVYHTYDEKYRQEQKGVISLSLSTHWAEPKSPGVPRDVEAADRMLQFSLGWFAHPIFRNGDYPDTMKWKVGNRSELQHLATSRLPSFTEEEKRFIRATADVFCLNTYYSRIVQHKTPRLNPPSYEDDQEMAEEEDPSWPSTAMNRAAPWGTRRLLNWIKEEYGDIPIYITENGVGLTNPNTEDTDRIFYHKTYINEALKAYRLDGIDLRGYVAWSLMDNFEWLNGYTVKFGLYHVDFNNTNRPRTARASARYYTEVITNNGMPLAREDEFLYGRFPEGFIWSAASAAYQIEGAWRADGKGLSIWDTFSHTPLRVENDAIGDVACDSYHKIAEDLVTLQNLGVSHYRFSISWSRILPDGTTRYINEAGLNYYVRLIDTLLAASIQPQVTIYHWDLPQTLQDVGGWENETIVQRFKEYADVLFQRLGDKVKFWITLNEPFVIAYQGYGYGTAAPGVSNRPGTAPYIVGHNLIKAHAEAWHLYNDVYRASQGGVISITISSDWAEPRDPSNQEDVEAARRYVQFMGGWFAHPIFKNGDYNEVMKTRIRDRSLAAGLNKSRLPEFTESEKRRINGTYDFFGFNHYTTVLAYNLNYATAISSFDADRGVASIADRSWPDSGSFWLKMTPFGFRRILNWLKEEYNDPPIYVTENGVSQREETDLNDTARIYYLRTYINEALKAVQDKVDLRGYTVWSAMDNFEWATGFSERFGLHFVNYSDPSLPRIPKASAKFYASVVRCNGFPDPATGPHACLHQPDAGPTISPVRQEEVQFLGLMLGTTEAQTALYVLFSLVLLGVCGLAFLSYKYCKRSKQGKTQRSQQELSPVSSF

SEQ ID NO: 51041 - protein, 1003 aa, Homo sapiens
KVAHLVLKAHARTWHHYNSHHRPQQQGHVGIVLNSDWAEPLSPERPEDLRASERFLHFMLGWFAHPVFVDGDYPATLRTQIQQMNRQCSHPVAQLPEFTEAEKQLLKGSADFLGLSHYTSRLISNAPQNTCIPSYDTIGGFSQHVNHVWPQTSSSWIRVVPWGIRRLLQFVSLEYTRGKVPIYLAGNGMPIGESENLFDDSLRVDYFNQYINEVLKAIKEDSVDVRSYIARSLIDGFEGPSGYSQRFGLHHVNFSDSSKSRTPRKSAYFFTSIIEKNGFLTKGAKRLLPPNTVNLPSKVRAFTFPSEVPSKAKVVWEKFSSQPKFERDLFYHGTFRDDFLWGVSSSAYQIEGAWDADGKGPSIWDNFTHTPGSNVKDNATGDIACDSYHQLDADLNMLRALKVKAYRFSISWSRIFPTGRNSSINSHGVDYYNRLINGLVASNIFPMVTLFHWDLPQALQDIGGWENPALIDLFDSYADFCFQTFGDRVKFWMTFNEPMYLAWLGYGSGEFPPGVKDPGWAPYRIAHAVIKAHARVYHTYDEKYRQEQKGVISLSLSTHWAEPKSPGVPRDVEAADRMLQFSLGWFAHPIFRNGDYPDTMKWKVGNRSELQHLATSRLPSFTEEEKRFIRATADVFCLNTYYSRIVQHKTPRLNPPSYEDDQEMAEEEDPSWPSTAMNRAAPWGTRRLLNWIKEEYGDIPIYITENGVGLTNPNTEDTDRIFYHKTYINEALKAYRLDGIDLRGYVAWSLMDNFEWLNGYTVKFGLYHVDFNNTNRPRTARASARYYTEVITNNGMPLAREDEFLYGRFPEGFIWSAASAAYQIEGAWRADGKGLSIWDTFSHTPLRVENDAIGDVACDSYHKIAEDLVTLQNLGVSHYRFSISWSRILPDGTTRYINEAGLNYYVRLIDTLLAASIQPQVTIYHWDLPQTLQDVGGWENETIVQRFKEYADVLFQRLGDKVKFWITLNEPFVIAYQGYGYGTAAPVHGRLVCTSYFQEWRLQ

SEQ ID NO: 51042 - protein, 334 aa, Homo sapiens
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDDEVAQLKKSADTLWDIQKDLKDL

SEQ ID NO: 51043 - protein, 232 aa, Homo sapiens
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVH

SEQ ID NO: 51044 - protein, 334 aa, Homo sapiens; identical to SEQ ID NO: 51042

SEQ ID NO: 51045 - protein, 137 aa, Homo sapiens
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVV

SEQ ID NO: 51046 - protein, 102 aa, Homo sapiens
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQ

SEQ ID NO: 51047 - protein, 332 aa, Homo sapiens
MSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQSAYEIIKLKGYTSWAIGLSVMDLVGSILKNLRRVHPVSTMVKGLYGIKEELFLSIPCVLGRNGVSDVVKINLNSEEEALFKKSAETLWNIQKDLIF

SEQ ID NO: 51048 - protein, 332 aa, Homo sapiens; identical to SEQ ID NO: 51047

SEQ ID NO: 51049 - protein, 507 aa, Homo sapiens
MARLLRSATWELFPWRGYCSQKAKGELCRDFVEALKAVVGGSHVSTAAVVREQHGRDESVHRCEPPDAVVWPQNVEQVSRLAALCYRQGVPIIPFGTGTGLEGGVCAVQGGVCVNLTHMDRILELNQEDFSVVVEPGVTRKALNAHLRDSGLWFPVDPGADASLCGMAATGASGTNAVRYGTMRDNVLNLEVVLPDGRLLHTAGRGRHFRFGFWPEIPHHTAWYSPCVSLGRRKSAAGYNLTGLFVGSEGTLGLITATTLRLHPAPEATVAATCAFPSVQAAVDSTVHILQAAVPVARIEFLDEVMMDACNRYSKLNCLVAPTLFLEFHGSQQALEEQLQRTEEIVQQNGASDFSWAKEAEERSRLWTARHNAWYAALATRPGCKGYSTDVCVPISRLPEIVVQTKEDLNASGLTGSIVGHVGDGNFHCILLVNPDDAEELGRVKAFAEQLGRRALALHGTCTGEHGIGMGKRQLLQEEVGAVGVETMRQLKAVLDPQGLMNPGKVL

SEQ ID NO: 51050 - protein, 484 aa, Homo sapiens
MARLLRSATWELFPWRGYCSQKAKGELCRDFVEALKAVVGGSHVSTAAVVREQHGRDESVHRCEPPDAVVWPQNVEQVSRLAALCYRQGVPIIPFGTGTGLEGGVCAVQGGVCVNLTHMDRILELNQEDFSVVVEPGVTRKALNAHLRDSGLWFPVDPGADASLCGMAATGASGTNAVRYGTMRDNVLNLEVVLPDGRLLHTAGRGRHFRKSAAGYNLTGLFVGSEGTLGLITATTLRLHPAPEATVAATCAFPSVQAAVDSTVHILQAAVPVARIEFLDEVMMDACNRYSKLNCLVAPTLFLEFHGSQQALEEQLQRTEEIVQQNGASDFSWAKEAEERSRLWTARHNAWYAALATRPGCKGYSTDVCVPISRLPEIVVQTKEDLNASGLTGSIVGHVGDGNFHCILLVNPDDAEELGRVKAFAEQLGRRALALHGTCTGEHGIGMGKRQLLQEEVGAVGVETMRQLKAVLDPQGLMNPGKVL

SEQ ID NO: 51051 - protein, 712 aa, Homo sapiens
MRVLLHLPALLASLILLQAAASTTRAQTTRTSAISDTVSQAKVQVNKAFLDSRTRLKTAMSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 51052 - protein, 457 aa, Homo sapiens
CFPVQFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 51053 - protein, 629 aa, Homo sapiens
MRVLLHLPALLASLILLQAAASTTRDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 51054 - protein, 653 aa, Homo sapiens
MSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 51055 - protein, 710 aa, Homo sapiens
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 51056 - protein, 666 aa, Homo sapiens
MRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 51057 - protein, 150 aa, Homo sapiens
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPAVFPVQIKDSSPTCVACVRGQGKTNVPSPPRNRTSATLVPSSV

SEQ ID NO: 51058 - protein, 281 aa, Homo sapiens
MTSKEDGKAAPGEERRRSPLDHLPPPANSNKPLTPFSIEDILNKPSVRRSYSLCGAAHLLAAADKHAQGGLPLAGRALLSQTSPLCALEELASKTFKGLEVSVLQAAEGRDGMTIFGQRQTPKKRRKSRTAFTNHQIYELEKRFLYQKYLSPADRDQIAQQLGLTNAQVITWFQNRRAKLKRDLEEMKADVESAKKLGPSGQMDIVALAELEQNSEATAGGGGGCGRAKSRPGSPVLPPGAPKAPGAGALQLSPASPLTDQPASSQDCSEDEEDEEIDVDD

SEQ ID NO: 51059 - protein, 198 aa, Homo sapiens
MNSGREPRTPRTLLSIADILAPRMVPRAPSAPQLPESGPGPTSPLCALEELTSKTFRGLDARALQPSEGRAGPDALGPGPFGRKRRKSRTAFTAQQVLELERRFVFQKYLAPSERDGLATRLGLANAQVVTWFQNRRAKLKRDVEEMRADVASLRALSPEVLCSLALPEGAPDPGLCLGPAGPDSRPHLSDEEIQVDD

SEQ ID NO: 51060 - protein, 194 aa, Homo sapiens
MGKRTSLEVSLGELGGEKCRGGRRSFPPLAASRPARPGGWRWARRDLCKTASRAENNSQACRPQRRAGPDALGPGPFGRKRRKSRTAFTAQQVLELERRFVFQKYLAPSERDGLATRLGLANAQVVTWFQNRRAKLKRDVEEMRADVASLRALSPEVLCSLALPEGAPDPGLCLGPAGPDSRPHLSDEEIQVDD

SEQ ID NO: 51061 - protein, 465 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEDEDGDDLLHHHHVSGSRR

SEQ ID NO: 51062 - protein, 634 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 51063 - protein, 572 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 51064 - protein, 491 aa, Homo sapiens
MQPLLCLGNLEDARERTGTLLAQHPAWGRTRAKPGSPLNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 51065 - protein, 614 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQSPQNCSIM

SEQ ID NO: 51066 - protein, 664 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 51067 - protein, 572 aa, Homo sapiens; identical to SEQ ID NO: 51063

SEQ ID NO: 51068 - protein, 491 aa, Homo sapiens; identical to SEQ ID NO: 51064

SEQ ID NO: 51069 - protein, 487 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGNSLRTALINSTGEEVAMRKLVRSVTVVEDDEDEDGDDLLHHHHVSGSRR

SEQ ID NO: 51070 - protein, 574 aa, Homo sapiens
MGNSEGCNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIIQEMGMRWEVEEGRRKVSLSCLP

SEQ ID NO: 51071 - protein, 615 aa, Homo sapiens
MPSRKFADGEVVRGRWPGSSLYYEVEILSHDSTSQLYTVKYKDGTELELKENDIKPLTSFRQRKGGSTSSSPSRRRGSRSRSRSRSPGRPPKSARRSASASHQADIKEARREVEVKLTPLILKPFGNSISRYNGEPEHIERNDAPHKNTQEKFSLSQESSYIATQYSLRPRREEVKLKEIDSKEEKYVAKELAVRTFEVTPIRAKDLEFGGVPGVFLIMFGLPVFLFLLLLMCKQKDPSLLNFPPPLPALYELWETRVFGVYLLWFLIQVLFYLLPIGKVVEGTPLIDGRRLKYRLNGFYAFILTSAVIGTSLFQGVEFHYVYSHFLQFALAATVFCVVLSVYLYMRSLKAPRNDLSPASSGNAVYDFFIGRELNPRIGTFDLKYFCELRPGLIGWVVINLVMLLAEMKIQDRAVPSLAMILVNSFQLLYVVDALWNEEALLTTMDIIHDGFGFMLAFGDLVWVPFIYSFQAFYLVSHPNEVSWPMASLIIVLKLCGYVIFRGANSQKNAFRKNPSDPKLAHLKTIHTSTGKNLLVSGWWGFVRHPNYLGDLIMALAWSLPCGFNHILPYFYIIYFTMLLVHREARDEYHCKKKYGVAWEKYCQRVPYRIFPYIY

SEQ ID NO: 51072 - protein, 615 aa, Homo sapiens; identical to SEQ ID NO: 51071

SEQ ID NO: 51073 - protein, 51 aa, Homo sapiens
MPSRKFADGEVVRGRWPGSSLYYEVEILSHDSTSQLYTVKYKDGTELELKE

SEQ ID NO: 51074 - protein, 128 aa, Homo sapiens
IGRELNPRIGTFDLKYFCELRPGLIGWVVINLVMLLAEMKIQDRAVPSLAMILVNSFQLLYVVDALWNEEALLTTMDIIHDGFGFMLAFGDLVWVPFIYSFQAFYLVSHPNEVSWPMASLIIVLKREY

SEQ ID NO: 51075 - protein, 213 aa, Homo sapiens
MPSRKFADGEVVRGRWPGSSLYYEVEILSHDSTSQLYTVKYKDGTELELKENDIKPLTSFRQRKGGSTSSSPSRRRGSRSRSRSRSPGRPPKSARRSASASHQADIKEARREVEVKLTPLILKPFGNSISRYNGEPEHIERNDAPHKNTQEKFSLSQESSYIATQYSLRPRREEVKLKEIDSKEEKYVAKELAVRTFEVTPIRAKDLEFGGVP

SEQ ID NO: 51076 - protein, 107 aa, Homo sapiens
  MOD_RES (1)..(1): Any amino acid
XSTSLKMYFYFYIDLKTIHTSTGKNLLVSGWWGFVRHPNYLGDLIMALAWSLPCGFNHILPYFYIIYFTMLLVHREARDEYHCKKKYGVAWEKYCQRVPYRIFPYIY

SEQ ID NO: 51077 - protein, 586 aa, Homo sapiens
MATATPVPPRMGSRAGGPTTPLSPTRLSRLQEKEELRELNDRLAVYIDKVRSLETENSALQLQVTEREEVRGRELTGLKALYETELADARRALDDTARERAKLQIELGKCKAEHDQLLLNYAKKESDLNGAQIKLREYEAALNSKDAALATALGDKKSLEGDLEDLKDQIAQLEASLAAAKKQLADETLLKVDLENRCQSLTEDLEFRKSMYEEEINETRRKHETRLVEVDSGRQIEYEYKLAQALHEMREQHDAQVRLYKEELEQTYHAKLENARLSSEMNTSTVNSAREELMESRMRIESLSSQLSNLQKESRACLERIQELEDLLAKEKDNSRRMLTDKEREMAEIRDQMQQQLNDYEQLLDVKLALDMEISAYRKLLEGEEERLKLSPSPSSRVTVSRASSSRSVRTTRGKRKRVDVEESEASSSVSISHSASATGNVCIEEIDVDGKFIRLKNTSEQDQPMGGWEMIRKIGDTSVSYKYTSRYVLKAGQTVTIWAANAGVTASPPTDLIWKNQNSWGTGEDVKVILKNSQGEEVAQRSTVFKTTIPEEEEEEEEAAGVVVEEELFHQQGTPRASNRSCAIM

SEQ ID NO: 51078 - protein, 600 aa, Homo sapiens
MATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQGDPRTTSRGCYVM

SEQ ID NO: 51079 - protein, 600 aa, Homo sapiens; identical to SEQ ID NO: 51078

SEQ ID NO: 51080 - protein, 216 aa, Homo sapiens
MLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVMSKSTWTPAGCQKGLSWLPMQRTKLLPEPRAFPVGAASFTISQVQSAKEGLGQRELKWGLAVKVPAKAGAGAGAGAVLKIRAGTGRERVPQATQMTRPNP

SEQ ID NO: 51081 - protein, 3075 aa, Homo sapiens
MRGGVLLVLLLCVAAQCRQRGLFPAILNLASNAHISTNATCGEKGPEMFCKLVEHVPGRPVRNPQCRICDGNSANPRERHPISHAIDGTNNWWQSPSIQNGREYHWVTITLDLRQVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRLQRIRTLNADLMTLSHREPKELDPIVTRRYYYSIKDISVGGMCICYGHASSCPWDETTKKLQCQCEHNTCGESCNRCCPGYHQQPWRPGTVSSGNTCEACNCHNKAKDCYYDESVAKQKKSLNTAGQFRGGGVCINCLQNTMGINCETCIDGYYRPHKVSPYEDEPCRPCNCDPVGSLSSVCIKDDLHSDLHNGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPVGQVNSMSGWLVTDLISPRKIPSQQDALGGRHQVSINNTAVMQRLAPKYYWAAPEAYLGNKLTAFGGFLKYTVSYDIPVETVDSNLMSHADVIIKGNGLTLSTQAEGLSLQPYEEYLNVVRLVPENFQDFHSKRQIDRDQLMTVLANVTHLLIRANYNSAKMALYRLESVSLDIASSNAIDLVVAADVEHCECPQGYTGTSCESCLSGYYRVDGILFGGICQPCECHGHAAECNVHGVCIACAHNTTGVHCEQCLPGFYGEPSRGTPGDCQPCACPLTIASNNFSPTCHLNDGDEVVCDWCAPGYSGAWCERCADGYYGNPTVPGESCVPCDCSGNVDPSEAGHCDSVTGECLKCLGNTDGAHCERCADGFYGDAVTAKNCRACECHVKGSHSAVCHLETGLCDCKPNVTGQQCDQCLHGYYGLDSGHGCRPCNCSVAGSVSDGCTDEGQCHCVPGVAGKRCDRCAHGFYAYQDGSCTPCDCPHTQNTCDPETGECVCPPHTQGVKCEECEDGHWGYDAEVGCQACNCSLVGSTHHRCDVVTGHCQCKSKFGGRACDQCSLGYRDFPDCVPCDCDLRGTSGDACNLEQGLCGCVEETGACPCKENVFGPQCNECREGTFALRADNPLGCSPCFCSGLSHLCSELEDYVRTPVTLGSDQPLLRVVSQSNLRGTTEGVYYQAPDFLLDAATVRQHIRAEPFYWRLPQQFQGDQLMAYGGKLKYSVAFYSLDGVGTSNFEPQVLIKGGRIRKQVIYMDAPAPENGVRQEQEVAMRENFWKYFNSVSEKPVTREDFMSVLSDIEYILIKASYGQGLQQSRISDISMEVGRKAEKLHPEEEVASLLENCVCPPGTVGFSCQDCAPGYHRGKLPAGSDRGPRPLVAPCVPCSCNNHSDTCDPNTGKCLNCGDNTAGDHCDVCTSGYYGKVTGSASDCALCACPHSPPASFSPTCVLEGDHDFRCDACLLGYEGKHCERCSSSYYGNPQTPGGSCQKCDCNPHGSVHGDCDRTSGQCVCRLGASGLRCDECEPRHILMETDCVSCDDECVGVLLNDLDEIGDAVLSLNLTGIIPVPYGILSNLENTTKYLQESLLKENMQKDLGKIKLEGVAEETDNLQKKLTRMLASTQKVNRATERIFKESQDLAIAIERLQMSITEIMEKTTLNQTLDEDFLLPNSTLQNMQQNGTSLLEIMQIRDFTQLHQNATLELKAAEDLLSQIQENYQKPLEELEVLKEAASHVLSKHNNELKAAEALVREAEAKMQESNHLLLMVNANLREFSDKKLHVQEEQNLTSELIVQGRGLIDAAAAQTDAVQDALEHLEDHQDKLLLWSAKIRHHIDDLVMHMSQRNAVDLVYRAEDHAAEFQRLADVLYSGLENIRNVSLNATSAAYVHYNIQSLIEESEELARDAHRTVTETSLLSESLVSNGKAAVQRSSRFLKEGNNLSRKLPGIALELSELRNKTNRFQENAVEITRQTNESLLILRAIPKGIRDKGAKTKELATSASQSAVSTLRDVAGLSQELLNTSASLSRVNTTLRETHQLLQDSTMATLLAGRKVKDVEIQANLLFDRLKPLKMLEENLSRNLSEIKLLISQARKQAASIKVAVSADRDCIRAYQPQISSTNYNTLTLNVKTQEPDNLLFYLGSSTASDFLAVEMRRGRVAFLWDLGSGSTRLEFPDFPIDDNRWHSIHVARFGNIGSLSVKEMSSNQKSPTKTSKSPGTANVLDVNNSTLMFVGGLGGQIKKSPAVKVTHFKGCLGEAFLNGKSIGLWNYIEREGKCRGCFGSSQNEDPSFHFDGSGYSVVEKSLPATVTQIIMLFNTFSPNGLLLYLGSYGTKDFLSIELFRGRVKVMTDLGSGPITLLTDRRYNNGTWYKIAFQRNRKQGVLAVIDAYNTSNKETKQGETPGASSDLNRLDKDPIYVGGLPRSRVVRRGVTTKSFVGCIKNLEISRSTFDLLRNSYGVRKGCLLEPIRSVSFLKGGYIELPPKSLSPESEWLVTFATTNSSGIILAALGGDVEKRGDREEAHVPFFSVMLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGHEQVDLDTCWLSERPKLAPDAEDSKLLPEPRAFPEQCVVDAALEYVPGAHQFGLTQNSHFILPFNQSAVRKKLSVELSIRTFASSGLIYYMAHQNQADYAVLQLHGGRLHFMFDLGKGRTKVSHPALLSDGKWHTVKTDYVKRKGFITVDGRESPMVTVVGDGTMLDVEGLFYLGGLPSQYQARKIGNITHSIPACIGDVTVNSKQLDKDSPVSAFTVNRCYAVAQEGTYFDGSGYAALVKEGYKVQSDVNITLEFRTSSQNGVLLGISTAKVDAIGLELVDGKVLFHVNNGAGRITAAYEPKTATVLCDGKWHTLQANKSKHRITLIVDGNAVGAESPHTQSTSVDTNNPIYVGGYPAGVKQKCLRSQTSFRGCLRKLALIKSPQVQSFDFSRAFELHGVFLHSCPGTES

SEQ ID NO: 51082 - protein, 3121 aa, Homo sapiens
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNTVADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 51083 - protein, 3122 aa, Homo sapiens
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIVADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLRLFNRPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 51084 - protein, 3122 aa, Homo sapiens
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 51085 - protein, 1128 aa, Homo sapiens
KKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNTVADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTASHWRLILPRPWN

SEQ ID NO: 51086 - protein, 1724 aa, Homo sapiens
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 51087 - protein, 3333 aa, Homo sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 51088 - protein, 3277 aa, Homo sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHMLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 51089 - protein, 1519 aa, Homo sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLRVYQGNKHPLFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGAHASPTSSGGSAPAVQQAYGFPRCKRKSCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAP

SEQ ID NO: 51090 - protein, 580 aa, Homo sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGNWCDCNLEGVLPEICDAHGRCLCRPGVEGPRCDTCRSGFYSFPICQGPSEKVAIYKPESRPSAETEPASTWILDFPASRTGEINFYCLSP

SEQ ID NO: 51091 - protein, 1668 aa, Homo sapiens
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHMLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 51092 - protein, 1823 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDALRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 51093 - protein, 88 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNS

SEQ ID NO: 51094 - protein, 120 aa, Homo sapiens
MALSSAWRSVLPLWLLWSAACSRAASGDDNAFPFDIEGSSAVGRQDPPETSEPRVALGRLPPAAEVQCPCHCHPAGAPAPPRAVPHSSFSLSPPLSSPQCLESFTWARSVRKLEIKSFPL

SEQ ID NO: 51095 - protein, 182 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERPSPQSTRGFPLNDS

SEQ ID NO: 51096 - protein, 178 aa, Homo sapiens
  MOD_RES (1)..(1): Any amino acid
XIFEDCDEVTGQCRNCLRNTTGFKCERCAPGYYGDARIAKNCAVCNCGGGPCDSVTGECLEEGFEPPTGMDCPTISCDKCVWDLTDALRLAALSIEEGKSGVLSVSSGAAAHRHVNEINATIYLLKTKLSERENQYALRKIQINNAENTMKSLLSDVEELVEKHWNKPRRRLELQEGV

SEQ ID NO: 51097 - protein, 1816 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDALRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 51098 - protein, 1816 aa, Homo sapiens; identical to SEQ ID NO: 51097

SEQ ID NO: 51099 - protein, 129 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVTTDGEDPGFSASALSFILSSQGAREARAPT

SEQ ID NO: 51100 - protein, 120 aa, Homo sapiens; identical to SEQ ID NO: 51094

SEQ ID NO: 51101 - protein, 374 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDALRLAALSIEEGKSGVLSVSSGAAAHRHVNEINATIYLLKTKLSERENQYALRKIQINNAENTMKSLLSDVEELVEKHWNKPRRRLELQEGV

SEQ ID NO: 51102 - protein, 120 aa, Homo sapiens; identical to SEQ ID NO: 51094

SEQ ID NO: 51103 - protein, 107 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTG

SEQ ID NO: 51104 - protein, 331 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDALRLAALSIEEGKSGVLSVSSGAAAHRHVNEINATIYLLKTKLSERENQ

SEQ ID NO: 51105 - protein, 81 aa, Homo sapiens
MALSSAWRSVLPLWLLWSAACSRAASGDDNAFPFDIEGSSAVGRQDPPETSEPRVALGRLPPAAEKCNAGFFHTLSGECVP

SEQ ID NO: 51106 - protein, 1816 aa, Homo sapiens; identical to SEQ ID NO: 51097

SEQ ID NO: 51107 - protein, 324 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDALRLAALSIEEGKSGVLSVSSGAAAHRHVNEINATIYLLKKTKQKNNKK

SEQ ID NO: 51108 - protein, 3695 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPKGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVFLRRVALEVASPAGQGALASNVELCLCPASYRGDSCQECAPGFYRDVKGLFLGRCVPCQCHGHSDRCLPGSGVCVDCQHNTEGAHCERCQAGFVSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRRLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 51109 - protein, 500 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVTNTKISWV

SEQ ID NO: 51110 - protein, 528 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNGVSLCRPGWSAVARSRLTSTSASWVQAILLPQSPE

SEQ ID NO: 51111 - protein, 1786 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 51112 - protein, 91 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNP

SEQ ID NO: 51113 - protein, 850 aa, Homo sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKRRFLKSIVMHSFRLTQPLWQGSIAAEPMLPS

SEQ ID NO: 51114 - protein, 1798 aa, Homo sapiens
MELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 51115 - protein, 380 aa, Homo sapiens
MQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILAQGIAQGAIRGAVADTRDTEQPVPGTGEDGRCRAGTELCR

SEQ ID NO: 51116 - protein, 1798 aa, Homo sapiens; identical to SEQ ID NO: 51114

SEQ ID NO: 51117 - protein, 1172 aa, Homo sapiens [sequence omitted]

SEQ ID NO: 51118 - protein, 1172 aa, Homo sapiens [sequence omitted]

SEQ ID NO: 51119 - protein, 1172 aa, Homo sapiens [sequence omitted]

SEQ ID NO: 51120 - protein, 188 aa, Homo sapiens
MRPFFLLCFALPGLLHAQQACSRGACYPPVGDLLVGRTRFLRASSTCGLTKPETYCTQYGEWQMKCCKCDSRQPHNYYSHRVENVASSSGPMRWWQSQNDVNPVSLQLDLDRRFQLQEVMMEFQGPMPAGMLIERSSDFGKTWRVYQYLAADCTSTFPRVRQGRPQSWQDVRCQSLPQRPNARLNGGK

SEQ ID NO: 51121 - protein, 160 aa, Homo sapiens
MNEIQAIAARLPNVDLVLSQTKQDIARARRLQAEAEEARSRAHAVEGQVEDVVGNLRQGTVALQEAQDTMQGTSRSLRLIQDRVAEVQQVLRPAEKLVTSMTKQLGDFWTRMEELRHQARQQGAEAVQAQQLAEGASEQALSAQEGFERIKQKYAELKDR

SEQ ID NO: 51122 - protein, 1609 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNIETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNLYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 51123 - protein, 1193 aa, Homo sapiens
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 51124 - protein, 1111 aa, Homo sapiens
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMGM

SEQ ID NO: 51125 - protein, 1010 aa, Homo sapiens
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAFPSQDPDQQPTAAHDVRAGREGTSAEGPPPFAGDKHRWDSG

SEQ ID NO: 51126 - protein, 529 aa, Homo sapiens
MAAAALLLGLALLAPRAAGAGMGACYDGAGRPQRCLPVFENAAFGRLAQASHTCGSPPEDFCPHVGAAGAGAHCQRCDAADPQRHHNASYLTDFHSQDESTWWQSPSMAFGVQYPTSVNITLRLGKAYEITYVRLKFHTSRPESFAIYKRSRADGPWEPYQFYSASCQKTYGRPEGQYLRPGEDERVAFCTSEFSDISPLSGGNVAFSTLEGRPSAYNFEESPGLQEWVTSTELLISLDRLNTFGDDIFKDPKVLQSYYYAVSDFSVGGRCKCNGHASECGPDVAGQLACRCQHNTTGTDCERCLPFFQDRPWARGTAEAAHECLPCNCSGRSEECTFDRELFRSTGHGGRCHHCRDHTAGPHCERCQENFYHWDPRMPCQPCDCQSAGSLHLQCDDTGTCACKPTVTGWKCDRCLPGFHSLSEGGCRPCTCNPAGSLDTCDPRSGRCPCKENVEGNLCDRCRPGTFNLQPHNPAGRSCRSRASRVTSPRSAPTNRTWRPFCTACPRTVPAGSEGCPDPRHTLPHLLFT

SEQ ID NO: 51127 - protein, 1575 aa, Homo sapiens
MAAAALLLGLALLAPRAAGAGMGACYDGAGRPQRCLPVFENAAFGRLAQASHTCGSPPEDFCPHVGAAGAGAHCQRCDAADPQRHHNASYLTDFHSQDESTWWQSPSMAFGVQYPTSVNITLRLGKAYEITYVRLKFHTSRPESFAIYKRSRADGPWEPYQFYSASCQKTYGRPEGQYLRPGEDERVAFCTSEFSDISPLSGGNVAFSTLEGRPSAYNFEESPGLQEWVTSTELLISLDRLNTFGDDIFKDPKVLQSYYYAVSDFSVGGRCKCNGHASECGPDVAGQLACRCQHNTTGTDCERCLPFFQDRPWARGTAEAAHECLPCNCSGRSEECTFDRELFRSTGHGGRCHHCRDHTAGPHCERCQENFYHWDPRMPCQPCDCQSAGSLHLQCDDTGTCACKPTVTGWKCDRCLPGFHSLSEGGCRPCTCNPAGSLDTCDPRSGRCPCKENVEGNLCDRCRPGTFNLQPHNPAGCSSCFCYGHSKVCASTAQFQVHHILSDFHQGAEGWWARSVGGSEHPPQWSPNGVLLSPEDEEELTAPEKFLGDQRFSYGQPLILTFRVPPGDSPLPVQLRLEGTGLALSLRHSSLSGPQDAGHPREVELRFHLQETSEDVAPPLPPFHFQRLLANLTSLRLRVSPGPSPAGPVFLTEVRLTSARPGLSPPASWVEICSCPTGYTGQFCESCAPGYKREMPQGGPYASCVPCTCNQHGTCDPNTGICVCSHHTEGPSCERCLPGFYGNPFAGQADDCQPCPCPGQSACTTIPESREVVCTHCPPGQRGRRCEVCDDGFFGDPLGLFGHPQPCHQCQCSGNVDPNAVGNCDPLSGHCLRCLHNTTGDHCEHCQEGFYGSALAPRPADKCMPCSCHPQGSVSEQMPCDPVTGQCSCLPHVTARDCSRCYPGFFDLQPGRGCRSCKCHPLGSQEDQCHPKTGQCTCRPGVTGQACDRCQLGFFGFSIKGCRACRCSPLGAASAQCHENGTCVCRPGFEGYKCDRCHDNFFLTADGTHCQQCPSCYALVKEEAAKLKARLTLTEGWLQGSDCGSPWGPLDILLGEAPRGDVYQGHHLLPGAREAFLEQMMSLEGAVKAAREQLQRLNKGARCAQAGSQKTCTQLADLEAVLESSEEEILHAAAILASLEIPQEGPSQPTKWSHLATEARALARSHRDTATKIAATAWRALLASNTSYALLWNLLEGRVALETQRDLEDRYQEVQAAQKALRTAVAEVLPEAESVLATVQQVGADTAPYLALLASPGALPQKSRAEDLGLKAKALEKTVASWQHMATEAARTLQTAAQATLRQTEPLTKLHQEARAALTQASSSVQAATVTVMGARTLLADLEGMKLQFPRPKDQAALQRKADSVSDRLLADTRKKTKQAERMLGNAAPLSSSAKKKGREAEVLAKDSAKLAKALLRERKQAHRRASRLTSQTQATLQQASQQVLASEARRQELEEAERVGAGLSEMEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 51128 - protein, 399 aa, Homo sapiens
MAQRAFPNPYADYNKSLAEGYFDAAGRLTPEFSQRLTNKIRELLQQMERGLKSADPRDGTGYTGWAGIAVLYLHLYDVFGDPAYLQLAHGYVKQSLNCLTKRSITFLCGDAGPLAVAAVLYHKMNNEKQAEDCITRLIHLNKIDPHAPNEMLYGRIGYIYALLFVNKNFGVEKIPQSHIQQICETILTSGENLARKRNFTAKSPLMYEWYQEYYVGAAHGLAGIYYYLMQPSLQVSQGKLHSLVKPSVDYVCQLKFPSGNYPPCIGDNRDLLVHWCHGAPGVIYMLIQAYKVFREEKYLCDAYQCADVIWQYGLLKKGYGLCHGSAGNAYAFLTLYNLTQDMKYLYRACKFAEWCLEYGEHGCRTPDTPFSLFEGMAGTIYFLADLLVPTKARFPAFEL

SEQ ID NO: 51129 - protein, 399 aa, Homo sapiens; identical to SEQ ID NO: 51128

SEQ ID NO: 51130 - protein, 399 aa, Homo sapiens; identical to SEQ ID NO: 51128

SEQ ID NO: 51131 - protein, 399 aa, Homo sapiens; identical to SEQ ID NO: 51128

SEQ ID NO: 51132 - protein, 196 aa, Homo sapiens
MAQRAFPNPYADYNKSLAEGYFDAAGRLTPEFSQRLTNKIRELLQQMERGLKSADPRDGTGYTGWAGIAVLYLHLYDVFGDPAYLQLAHGYVKQSLNCLTKRSITFLCGDAGPLAVAAVLYHKMNNEKQAEDCITRLIHLNKIDPHAPNEMLYGRIGYIYALLFVNKNFGVEKIPQSHIQQICETILTSGENLARK

SEQ ID NO: 51133 - protein, 399 aa, Homo sapiens; identical to SEQ ID NO: 51128

SEQ ID NO: 51134 - protein, 450 aa, Homo sapiens
MGETMSKRLKLHLGGEAEMEERAFVNPFPDYEAAAGALLASGAAEETGCVRPPATTDEPGLPFHQDGKIIHNFIRRIQTKIKDLLQQMEEGLKTADPHDCSAYTGWTGIALLYLQLYRVTCDQTYLLRSLDYVKRTLRNLNGRRVTFLCGDAGPLAVGAVIYHKLRSDCESQECVTKLLQLQRSVVCQESDLPDELLYGRAGYLYALLYLNTEIGPGTVCESAIKEVVNAIIESGKTLSREERKTERCPLLYQWHRKQYVGAAHGMAGIYYMLMQPAAKVDQETLTEMVKPSIDYVRHKKFRSGNYPSSLSNETDRLVHWCHGAPGVIHMLMQAYKVFKEEKYLKEAMECSDVIWQRGLLRKGYGICHGTAGNGYSFLSLYRLTQDKKYLYRACKFAEWCLDYGAHGCRIPDRPYSLFEGMAGAIHFLSDVLGPETSRFPAFELDSSKRD

SEQ ID NO: 51135 - protein, 732 aa, Homo sapiens
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 51136 - protein, 732 aa, Homo sapiens; identical to SEQ ID NO: 51135

SEQ ID NO: 51137 - protein, 652 aa, Homo sapiens
MTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 51138 - protein, 721 aa, Homo sapiens
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 51139 - protein, 658 aa, Homo sapiens
MGRRRAPAGGSLGRALMRHQTQRSRSHRHTDSWLHTSELNDGYDWGRLNLQSVTEQSSLDDFLATAELAGTEFVAEKLNIKFVPAEARTGLLSFEESQRIKKLHEENKQFLCIPRRPNWNQNTTPEELKQAEKDNFLEWRRQLVRLEEEQKLILTPFERNLDFWRQLWRVIERSDIVVQIVDARNPLLFRCEDLECYVKEMDANKENVILINKADLLTAEQRSAWAMYFEKEDVKVIFWSALAGAIPLNGDSEEEANRDDRQSNTTKFGHSSFDQAEISHSESEHLPARDSPSLSENPTTDEDDSEYEDCPEEEEDDWQTCSEEDGPKEEDCSQDWKESSTADSEARSRKTPQKRQIHNFSHLVSKQELLELFKELHTGRKVKDGQLTVGLVGYPNVGKSSTINTIMGNKKVSVSATPGHTKHFQTLYVEPGLCLCDCPGLVMPSFVSTKAEMTCSGILPIDQMRDHVPPVSLVCQNIPRHVLEATYGINIITPREDEDPHRPPTSEELLTAYGYMRGFMTAHGQPDQPRSARYILKDYVSGKLLYCHPPPGRDPVTFQHQHQRLLENKMNSDEIKMQLGRNKKAKQIENIVDKTFFHQENVRALTKGVQAVMGYKPGSGVVTASTASSENGAGKPWKKHGNRNKKEKSRRLYKHLDM

SEQ ID NO: 51140 - protein, 110 aa, Homo sapiens
MSCQQSQQQCQPPPKCTPKCPPKCPTPKCPPKCPPKCPPVSSCCSVSSGGCCGSSSGGGCSSGGGGCCLSHHRRHRSHRHRLQSSGCCSQPSGGSSCCGGDSGQHSGGCC

SEQ ID NO: 51141 - protein, 110 aa, Homo sapiens; identical to SEQ ID NO: 51140

SEQ ID NO: 51142 - protein, 118 aa, Homo sapiens
MSCQQNQQQCQPPPKCIPKCPPKCLTPRCPPKCPPKCPPVSSCCSVSSGGCCGSSSGGSCGSSSGGCCSSGGGGCCLSHHRRRRSHCHRPQSSGCCSQPSGGSSCCGGGSGQHSGGCC

SEQ ID NO: 51143 - protein, 110 aa, Homo sapiens
MSCQQNQQQCQPPPKCIPKCPPKCLTPRCPPKCPPKCPPVSSCCSVSSGGCCGSSSGGCCSSGGGGCCLSHHRRRRSHCHRPQSSGCCSQPSGGSSCCGGGSGQHSGGCC

SEQ ID NO: 51144 - protein, 118 aa, Homo sapiens
MSCQQSQQQCQPPPKCTPKCPPKCPTPKCPPKCPPKCPPVSSCCSVSSGGCCGSSSGGSCGSSSGGCCSSGGGGCCLSHHRRRRSHCHRPQSSGCCSQPSGGSSCCGGGSGQHSGGCC

SEQ ID NO: 51145 - protein, 114 aa, Homo sapiens
MSCQQSQQQCQPPPKCTPKCTPKCPAPKCPPKCPPVSSCCSVSSGGCCGSSSGGGCGSNSGGCCSSGGGGCCLSHHRRHRSHRRRPQSSDCCSQPSGGSSCCGGGSSQHSGGCC

SEQ ID NO: 51146 - protein, 118 aa, Homo sapiens
MSCQQSQQQCQPPPKCTPKCPPKCPTPKCPPKCPPKCPPVSSCCSVSSGGCCGSSSGGSCGSSSGGCCSSGGGGCCLSHHRHHRSHRHRPQSSDCCSQPSGGSSCCGGGSGQHSGGCC

SEQ ID NO: 51147 - protein, 118 aa, Homo sapiens; identical to SEQ ID NO: 51146

SEQ ID NO: 51148 - protein, 118 aa, Homo sapiens
MSCQQSQQQCQPPPKCTPKCPPKCPTPKCPPKCPPKCPPVSSCCSVSSGGCCGSSSGGCCSSGGGGCCSSGGGGCCLSHHRRRRSHRHRPQSSDCCSQPSAGSSCCGGGSGQHSGGCC

SEQ ID NO: 51149 - protein, 106 aa, Homo sapiens
MSCQQNQQQCQPPPKCPPKCPPKCPPKCRPQCPAPCPPPVSSCCGPSSGGCCGSSSGGCCSSGGGGCCLSHHRPRLFHRHRHQSPDCCECEPSGGSGCCHSSGDCC

SEQ ID NO: 51150 - protein, 110 aa, Homo sapiens
MSCQQNQQQCQPPPKCPPKCTPKCPPKCPPKCLPQCPAPCSPAVSSCCGPISGGCCGPSSGGCCNSGAGGCCLSHHRPRLFHRRRHQSPDCCESEPSGGSGCCHSSGGCC

SEQ ID NO: 51151 - protein, 110 aa, Homo sapiens; identical to SEQ ID NO: 51150

SEQ ID NO: 51152 - protein, 110 aa, Homo sapiens
MSCQQNQQQCQPPPKCPPKCTPKCPPKCPPKCPPQCPAPCFPAVSSCCGPSSGSCCGPSSGGCCSSGAGGCSLSHHRPRLFHRRRHQSPDCCESEPSGGSGCCHSSGGCC

SEQ ID NO: 51153 - protein, 110 aa, Homo sapiens
MSCQQNQQQCQPPPKCPPKCTPKCPPKCPPKCPPQCPAPCSPAVSSCCGPSSGSCCGPSSGGCCSSGGGGCCLSHHRPRLFHRRRHQSPDCCESEPSGASGCCHSSGGCC

SEQ ID NO: 51154 - protein, 89 aa, Homo sapiens
MSCQQNQQQCQPPPKCPAKSPAQCLPPASSSCAPSSGGCGPSSERSCCLSHHRCRRSHRCRCQSSNSCDRGSGQQGGSSSCGHSSAGCC

SEQ ID NO: 51155 - protein, 95 aa, Homo sapiens
MSCQQNQQQCQPLPKCPSPKCPPKSSAQCLPPASSCCAPRPGCCGGPSSEGGCCLSHHRCCRSHRCRRQSSNSCDRGSGQQDGASDCGYGSGGCC

SEQ ID NO: 51156 - protein, 94 aa, Homo sapiens
MSCQQNQQQCQPPPSCPSPKCPPKSPAQCLPPPSSDCALSSGGCGPSSESGCCLSHHRHFRSHQCRRQRSNSCDRGSGQQGGGSCRGHGSGGCC

SEQ ID NO: 51157 - protein, 92 aa, Homo sapiens
MSCQQNQQQCQPPPKCPSPKCPPKSPVQCLPPASSGCAPSSGGCGPSSEGGCFLNHHRRHHRCRRQRPNSCDRGSGQQGGGSGCGHGSGGCC

SEQ ID NO: 51158 - protein, 92 aa, Homo sapiens
MSCQQNQKQCQPPPKCPSPKCPPKNPVQCLPPASSGCAPSSGGCGPSSEGGCFLNHHRRHHRCRRQRSNSCDRGSGQQGGGSGCCHGSGGCC

SEQ ID NO: 51159 - protein, 99 aa, Homo sapiens
MSCQQNQQQCQPPPKCPIPKYPPKCPSKCASSCPPPISSCCGSSSGGCGCCSSEGGGCCLSHHRHHRSHCHRPKSSNCYGSGSGQQSGGSGCCSGGGCC

SEQ ID NO: 51160 - protein, 99 aa, Homo sapiens; identical to SEQ ID NO: 51159

SEQ ID NO: 51161 - protein, 118 aa, Homo sapiens
MSCQQSQQQCQPPPKCTPKCPPKCTPKCPPKCPPKCPPQCSAPCPPPVSSCCGSSSGGCCSSEGGGCCLSHHRPRQSLRRRPQSSSCCGSGSGQQSGGSSCCHSSGGSGCCHSSGGCC

SEQ ID NO: 51162 - protein, 98 aa, Homo sapiens
MSSDDKSKSNDPKTEPKNCDPKCEQKCESKCQPSCLKKLLQRCFEKCPWEKCPAPPKCLPCPSQSPSSCPPQPCTKPCPPKCPSSCPHACPPPCPPPE

SEQ ID NO: 51163 - protein, 619 aa, Homo sapiens
MCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 51164 - protein, 1722 aa, Homo sapiens
MAGAWLRWGLLLWAGLLASSAHGRLRRITYVVHPGPGLAAGALPLSGPPRSRTFNVALNARYSRSSAAAGAPSRASPGVPSERTRRTSKPGGAALQGLRPPPPPPPEPARPAVPGGQLHPNPGGHPAAAPFTKQGRQVVRSKVPQETQSGGGSRLQVHQKQQLQGVNVCGGRCCHGWSKAPGSQRCTKPSCVPPCQNGGMCLRPQLCVCKPGTKGKACETIAAQDTSSPVFGGQSPGAASSWGPPEQAAKHTSSKKADTLPRVSPVAQMTLTLKPKPSVGLPQQIHSQVTPLSSQSVVIHHGQTQEYVLKPKYFPAQKGISGEQSTEGSFPLRYVQDQVAAPFQLSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPGIVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 51165 - protein, 1396 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPGIVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 51166 - protein, 1721 aa, Homo sapiens
MAGAWLRWGLLLWAGLLASSAHGRLRRITYVVHPGPGLAAGALPLSGPPRSRTFNVALNARYSRSSAAAGAPSRASPGVPSERTRRTSKPGGAALQGLRPPPPPPPEPARPAVPGGQLHPNPGGHPAAAPFTKQGRQVVRSKVPQETQSGGGSRLQVHQKQQLQGVNVCGGRCCHGWSKAPGSQRCTKPSCVPPCQNGGMCLRPQLCVCKPGTKGKACETIAAQDTSSPVFGGQSPGAASSWGPPEQAAKHTSSKKADTLPRVSPVAQMTLTLKPKPSVGLPQQIHSQVTPLSSQSVVIHHGQTQEYVLKPKYFPAQKGISGEQSTEGSFPLRYVQDQVAAPFQLSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 51167 - protein, 1395 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 51168 - protein, 1353 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 51169 - protein, 1342 aa, Homo sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 51170 - protein, 1821 aa, Homo sapiens
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 51171 - protein, 1303 aa, Homo sapiens
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 51172 - protein, 263 aa, Homo sapiens
MLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSAAACRGRAAPCASVPAASSSTPPAPAAWISTSAES

SEQ ID NO: 51173 - protein, 1256 aa, Homo sapiens
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 51174 - protein, 306 aa, Homo sapiens
MLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 51175 - protein, 1137 aa, Homo sapiens
MTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSG

SEQ ID NO: 51176 - protein, 733 aa, Homo sapiens
MPAETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 51177 - protein, 882 aa, Homo sapiens
MTLIGENGHSTDTLTGSGFRVADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 51178 - protein, 1586 aa, Homo sapiens
MGDVKALLFVAAARARRLGGAAASESLAVSEAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 51179 - protein, 186 aa, Homo sapiens
MLGGAGGGPGLRTPCPADVDECSEEDLCQSGICTNTDGSFECICPPGHRAGPDLASCLDVDECRERGPALCGSQRCENSPGSYRCVRDCDPGYHAGPEGTCDDVDECRNRSFCGAHAVCQNLPGSFQCLCDQYEGARDGRHCVDVNECETLQGVCGAALCENVEGSFLCVCPNSPEEFDPMTGRCV

SEQ ID NO: 51180 - protein, 1623 aa, Homo sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 51181 - protein, 384 aa, Homo sapiens
MTGRCVPPRTSADVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 51182 - protein, 1556 aa, Homo sapiens
MAGGVRLLWVSLLVLLAQLGPQPGLGRLGERLRVRFTPVVCGLRCVHGPTGSRCTPTCAPRNATSVDSGAPGGAAPGGPGFRAFLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 51183 - protein, 899 aa, Homo sapiens
MCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEEL

SEQ ID NO: 51184 - protein, 212 aa, Homo sapiens
MWTSATACRRRVTSGAARTRQAASCACAPPGTRLHRTEPAARMWMSVPEAPHPAPTAGVRTQKAASSVSAPWASNPTLLAPNVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLGSYPG

SEQ ID NO: 51185 - protein, 222 aa, Homo sapiens
MEIPPTNYPASRAALVAQNYINYQQGTPHRVFEVQKVKQASMEDIPGRGHKYHLKFAVEEIIQKQVKVNCTAEVLYPSTGQETAPEVNFTFEGETGKNPDEEDNTFYQRLKSMKEPLEAQNIPDNFGNVSPEMTLVLHLAWVACGYIIWQNSTEDTWYKMVKIQTVKQVQRNDDFIELDYTILLHNIASQEIIPWQMQVLWHPQYGTKVKHNSRLPKEVQLE

SEQ ID NO: 51186 - protein, 295 aa, Homo sapiens
MGLPVSWAPPALWVLGCCALLLSLWALCTACRRPEDAVAPRKRARRQRARLQGSATAAEASLLRRTHLCSLSKSDTRLHELHRGPRSSRALRPASMDLLRPHWLEVSRDITGPQAAPSAFPHQELPRALPAAAATAGCAGLEATYSNVGLAALPGVSLAASPVVAEYARVQKRKGTHRSPQEPQQGKTEVTPAAQVDVLYSRVCKPKRRDPGPTTDPLDPKGQGAILALAGDLAYQTLPLRALDVDSGPLENVYESIRELGDPAGRSSTCGAGTPPASSCPSLGRGWRPLPASLP

SEQ ID NO: 51187 - protein, 107 aa, Homo sapiens
MGLPVSWAPPALWVLGCCALLLSLWALCTACRRPEDAVAPRKRARRQRARLQGSATAAEASLLRRTHLCSLSKSDTRLHELHRGPRSSRALRPASMDLLRPHWLEVS

SEQ ID NO: 51188 - protein, 697 aa, Homo sapiens
MGERAGSPGTDQERKAGKHHYSYLSDFETPQSSGRSSLVSSSPASVRRKNPKRQTSDGQVHHQAPRKPSPKGLPNRKGVRVGFRSQSLNREPLRKDTDLVTKRILSARLLKINELQNEVSELQVKLAELLKENKSLKRLQYRQEKALNKFEDAENEISQLIFRHNNEITALKERLRKSQEKERATEKRVKDTESELFRTKFSLQKLKEISEARHLPERDDLAKKLVSAELKLDDTERRIKELSKNLELSTNSFQRQLLAERKRAYEAHDENKVLQKEVQRLYHKLKEKERELDIKNIYSNRLPKSSPNKEKELALRKNAACQSDFADLCTKGVQTMEDFKPEEYPLTPETIMCYENKWEEPGHLTLDLQSQKQDRHGEAGILNPIMEREEKFVTDEELHVVKQEVEKLEDEWEREELDKKQKEKASLLEREEKPEWETGRYQLGMYPIQNMDKLQGEEEERLKREMLLAKLNEIDRELQDSRNLKYPVLPLLPDFESKLHSPERSPKTYRFSESSERLFNGHHLQDISFSTPKGEGQNSGNVRSPASPNEFAFGSYVPSFAKTSERSNPFSQKSSFLDFQRNSMEKLSKDGVDLITRKEKKANLMEQLFGASGSSTISSKSSDPNSVASSKGDIDPLNFLPGNKGSRDQEHDEDEGFFLSEGRSFNPNRHRLKHADDKPAVKAADSVEDEIEEVALR

SEQ ID NO: 51189 - protein, 697 aa, Homo sapiens; identical to SEQ ID NO: 51188

SEQ ID NO: 51190 - protein, 230 aa, Homo sapiens
MKNPMLEVVSLLLEKLLLISNFTLFSSGAAGEDKGRNSFYETSSFHRGDVLEVPRTHLTHYGIYLGDNRVAHMMPDILLALTDDMGRTQKVVSNKRLILGVIVKVASIRVDTVEDFAYGANILVNHLDESLQKKALLNEEVARRAEKLLGFTPYSLLWNNCEHFVTYCRYGTPISPQSDKFCETVKIIIRDQRSVLASAVLGLASIVCTGLVSYTTLPAIFIPFFLWMAG

SEQ ID NO: 51191 - protein, 69 aa, Homo sapiens
MKNPMLEVVSLLLEKLLLISNFTLFSSGAAGEDKGRNSFYETSSFHRGDVLEVPRTHLTHYGIYLGDNR

SEQ ID NO: 51192 - protein, 230 aa, Homo sapiens; identical to SEQ ID NO: 51190

SEQ ID NO: 51193 - protein, 135 aa, Homo sapiens
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 51194 - protein, 327 aa, Homo sapiens
MSQPSGGRAPGTRIYSWSCPTVMSPGEKLDPIPDSFILQPPVFHPVVPYVTTIFGGLHAGKMVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 51195 - protein, 337 aa, Homo sapiens
MSQPSGGRAPGTRIYSWSCPTVMSPGEKLDPIPDSFILQPPVFHPVVPYVTTIFGGLHAGKMVMLQGVVPLDAHSRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHPFLLMSPRLEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 51196 - protein, 336 aa, Homo sapiens
MSQPSGGRAPGTRIYSWSCPTVMSPGEKLDPIPDSFILQPPVFHPVVPYVTTIFGGLHAGKMVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHPFLLMSPRLEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 51197 - protein, 275 aa, Homo sapiens
MVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHPFLLMSPRLEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 51198 - protein, 266 aa, Homo sapiens
MVMLQGVVPLDAHRFQVDFQCGCSLCPRPDIAFHFNPRFHTTKPHVICNTLHGGRWQREARWPHLALRRGSSFLILFLFGNEEVKVSVNGQHFLHFRYRLPLSHVDTLGIFGDILVEAVGFLNINPFVEGSREYPAGHEVPCSHALPQGLSPGQVIIVRGLVLQEPKHFTVSLRDQAAHAPVTLRASFADRTLAWISRWGQKKLISAPFLFYPQRFFEVLLLFQEGGLKLALNGQGLGATSMNQQALEQLRELRISGSVQLYCVHS

SEQ ID NO: 51199 - protein, 139 aa, Homo sapiens
MSSLPVPYKLPVSLSVGSCVIIKGTPIHSFINDPQLQVDFYTDMDEDSDIAFRFRVHFGNHVVMNRREFGIWMLEETTDYVPFEDGKQFELCIYVHYNEYEIKVNGIRIYGFVHRIPPSFVKMVQVSRDISLTSVCVCN

SEQ ID NO: 51200 - protein, 132 aa, Homo sapiens
MTGELEVKNMDMKPGSTLKITGSIADGTDGFVINLGQGTDKLNLHFNPRFSESTIVCNSLDGSNWGQEQREDHLCFSPGSEVKFTVTFESDKFKVKLPDGHELTFPNRLGHSHLSYLSVRGGFNMSSFKLKE

SEQ ID NO: 51201 - protein, 30 aa, Homo sapiens
MTGELEVKNMDMKPGSTLKITGSIADGTDG

SEQ ID NO: 51202 - protein, 585 aa, Homo sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLRYFYSRRIDITLSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPCPAGHFNGFRTVIRPFYLTNSSGVD

SEQ ID NO: 51203 - protein, 573 aa, Homo sapiens
MTPPRLFWVWLLVAGTQGVNDGDMRLADGGATNQGRVEIFYRGQWGTVCDNLWDLTDASVVCRALGFENATQALGRAAFGQGSGPIMLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLRYFYSRRIDITLSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPCPAGHFNGFRTVIRPFYLTNSSGVD

SEQ ID NO: 51204 - protein, 136 aa, Homo sapiens
MSNVPHKSSLPEGIRPGTVLRIRGLVPPNASRFHVNLLCGEEQGSDAALHFNPRLDTSEVVFNSKEQGSWGREERGPGVPFQRGQPFEVLIIASDDGFKAVVGDAQYHHFRHRLPLARVRLVEVGGDVQLDSVRIF

SEQ ID NO: 51205 - protein, 317 aa, Homo sapiens
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLRLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 51206 - protein, 359 aa, Homo sapiens
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLPSNRGGDISKIAPRTVYTKSKDSTVNHTLTCTKIPPMNYVSKRLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 51207 - protein, 358 aa, Homo sapiens
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLRLSLPSWDLQGHGSETFRSVLWTRVFEIAFCRPLGTVASFQRLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 51208 - protein, 317 aa, Homo sapiens; identical to SEQ ID NO: 51205

SEQ ID NO: 51209 - protein, 208 aa, Homo sapiens
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELTEISRENVPKSGTPQLPSNRGGDISKIAPRTVYTKSKDSTV

SEQ ID NO: 51210 - protein, 300 aa, Homo sapiens
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVPKSGTPQLPSNRGGDISKIAPRTVYTKSKDSTVNHTLTCTKIPPMNYVSKRLPFAARLNTPMGPGRTVVVKGEVNANAKSFNVDLLAGKSKDIALHLNPRLNIKAFVRNSFLQESWGEEERNITSFPFSPGMYFEMIIYCDVREFKVAVNGVHSLEYKHRFKELSSIDTLEINGDIHLLEVRSW

SEQ ID NO: 51211 - protein, 359 aa, Homo sapiens; identical to SEQ ID NO: 51206

SEQ ID NO: 51212 - protein, 168 aa, Homo sapiens
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIVIMVLKDKFQVAVNGKHTLLYGHRIGPEKIDTLGIYGKVNIHSIGFSFSSDLQSTQASSLELT

SEQ ID NO: 51213 - protein, 106 aa, Homo sapiens
MMLSLNNLQNIIYNPVIPFVGTIPDQLDPGTLIVIRGHVPSDADRFQVDLQNGSSMKPRADVAFHFNPRFKRAGCIVCNTLINEKWGREEITYDTPFKREKSFEIV

SEQ ID NO: 51214 - protein, 359 aa, Homo sapiens; identical to SEQ ID NO: 51206

SEQ ID NO: 51215 - protein, 317 aa, Homo sapiens; identical to SEQ ID NO: 51205

SEQ ID NO: 51216 - protein, 359 aa, Homo sapiens; identical to SEQ ID NO: 51206

SEQ ID NO: 51217 - protein, 43 aa, Homo sapiens
MMLSLNNLQNIIYNPVIPFVGTIPDQLDPGTLIVIRGHVPSDA

SEQ ID NO: 51218 - protein, 323 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 51219 - protein, 311 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQTQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 51220 - protein, 246 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRCGSCVKLTASRWPWMVSTCLNTTIA

SEQ ID NO: 51221 - protein, 355 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 51222 - protein, 221 aa, Homo sapiens
MGPFSAPVEPDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRCGSCVKLTASRWPWMVSTCLNTTIA

SEQ ID NO: 51223 - protein, 119 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVHLLLLLL

SEQ ID NO: 51224 - protein, 510 aa, Homo sapiens
MAGSRQRGLRARVRPLFCALLLSLGRFVRGDGVGGDPAVALPHRRFEYKYSFKGPHLVQSDGTVPFWAHAGNAIPSSDQIRVAPSLKSQRGSVWTKTKAAFENWEVEVTFRVTGRGRIGADGLAIWYAENQGLEGPVFGSADLWNGVGIFFDSFDNDGKKNNPAIVIIGNNGQIHYDHQNDGASQALASCQRDFRNKPYPVRAKITYYQNTLTVMINNGFTPDKNDYEFCAKVENMIIPAQGHFGISAATGGLADDHDVLSFLTFQLTEPGKEPPTPDKEISEKEKEKYQEEFEHFQQELDKKKEEFQKGHPDLQGQPAEEIFESVGDRELRQVFEGQNRIHLEIKQLNRQLDMILDEQRRYVSSLTEEISKRGAGMPGQHGQITQQELDTVVKTQHEILRQVNEMKNSMSETVRLVSGMQHPGSAGGVYETTQHFIDIKEHLHIVKRDIDNLVQRNMPSNEKPKCPELPPFPSCLSTVHFIIFVVVQTVLFIGYIMYRSQQEAAAKKFF

SEQ ID NO: 51225 - protein, 366 aa, Homo sapiens
MQPLWLCWALWVLPLASPGAALTGEQLLGSLLRQLQLKEVPTLDRADMEELVIPTHVRAQYVALLQRSHGDRSRGKRFSQSFREVAGRFLALEASTHLLVFGMEQRLPPNSELVQAVLRLFQEPVPKAALHRHGRLSPRSARARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLGDYGAQGDCDPEAPMTEGTRCCRQEMYIDLQGMKWAENWVLEPPGFLAYECVGTCRQPPEALAFKWPFLGPRQCIASETDSLPMIVSIKEGGRTRPQVVSLPNMRVQKCSCASDGALVPRRLQP

SEQ ID NO: 51226 - protein, 366 aa, Homo sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 51227 - protein, 332 aa, Homo sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 51228 - protein, 376 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDYEYALRHLYVLVNLCEKPYPLHRIKLSMDHVCLGHY

SEQ ID NO: 51229 - protein, 372 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDDKIVHGPRVPWSLLKSCLLEAFPSVSAPPTVC

SEQ ID NO: 51230 - protein, 433 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 51231 - protein, 433 aa, Homo sapiens; identical to SEQ ID NO: 51230

SEQ ID NO: 51232 - protein, 398 aa, Homo sapiens
MVWKVAVFLSVALGIGAVPIDDPEDGGKHWVVIVAGSNGWYNYRHQADACHAYQIIHRNGIPDEQIVVMMYDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 51233 - protein, 410 aa, Homo sapiens
MVWKVAVFLSVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 51234 - protein, 57 aa, Homo sapiens
MVWKVAVFLSVALGIGAVPIDDPEDGGKHWVVIVAGSNGWYNYRHQADACHAYQIIH

SEQ ID NO: 51235 - protein, 19 aa, Homo sapiens
MVWKVAVFLSVALGIGAVP

SEQ ID NO: 51236 - protein, 58 aa, Homo sapiens
MVWKVAVFLSVALGIGAVPIDDPEDGGKHWVVIVAGSNGWYNYRHQADACHAYQIIHR

SEQ ID NO: 51237 - protein, 78 aa, Homo sapiens
MVWKVAVFLSVALGIGAVPIDDPEDGGKHWVVIVAGSNGWYNYRHQADACHAYQIIHRNGIPDEQIVVMMYDDIAYSE

SEQ ID NO: 51238 - protein, 78 aa, Homo sapiens; identical to SEQ ID NO: 51237

SEQ ID NO: 51239 - protein, 911 aa, Homo sapiens
MAAAAASAPQQLSDEELFSQLRRYGLSPGPVTESTRPVYLKKLKKLREEEQQQHRSGGRGNKTRNSNNNNTAAATVAAAGPAAAAAAGMGVRPVSGDLSYLRTPGGLCRISASGPESLLGGPGGASAAPAAGSKVLLGFSSDESDVEASPRDQAGGGGRKDRASLQYRGLKAPPAPLAASEVTNSNSAERRKPHSWWGARRPAGPELQTPPGKDGAVEDEEGEGEDGEERDPETEEPLWASRTVNGSRLVPYSCRENYSDSEEEDDDDVASSRQVLKDDSLSRHRPRRTHSKPLPPLTAKSAGGRLETSVQGGGGLAMNDRAAAAGSLDRSRNLEEAAAAEQGGGCDQVDSSPVPRYRVNAKKLTPLLPPPLTDMDSTLDSSTGSLLKTNNHIGGGAFSVDSPRIYSNSLPPSAAVAASSSLRINHANHTGSNHTYLKNTYNKPKLSEPEEELLQQFKREEVSPTGSFSAHYLSMFLLTAACLFFLILGLTYLGMRGTGVSEDGELSIENPFGETFGKIQESEKTLMMNTLYKLHDRLAQLAGDHECGSSSQRTLSVQEAAAYLKDLGPEYEGIFNTSLQWILENGKDVGIRCVGFGPEEELTNITDVQFLQSTRPLMSFWCRFRRAFVTVTHRLLLLCLGVVMVCVVLRYMKYRWTKEEEETRQMYDMVVKIIDVLRSHNEACQENKDLQPYMPIPHVRDSLIQPHDRKKMKKVWDRAVDFLAANESRVRTETRRIGGADFLVWRWIQPSASCDKILVIPSKVWQGQAFHLDRRNSPPNSLTPCLKIRNMFDPVMEIGDQWHLAIQEAILEKCSDNDGIVHIAVDKNSREGCVYVKCLSPEYAGKAFKALHGSWFDGKLVTVKYLRLDRYHHRFPQALTSNTPLKPSNKHMNSMSHLRLRTGLTNSQGSS
